US009074006B2

(12) United States Patent
Himanen et al.

(10) Patent No.: US 9,074,006 B2
(45) Date of Patent: Jul. 7, 2015

(54) USE OF HUB1 POLYNUCLEOTIDES FOR IMPROVING GROWTH CHARACTERISTICS IN PLANTS

(75) Inventors: Kristiina Himanen, Ghent (BE); Maria Van Lijsebettens, Merelbeke (BE); Christophe Reuzeau, Tocan Saint Apre (FR); Tommaso Matteo Boccardi, Ghent (BE)

(73) Assignees: BASF Plant Science GmbH, Ludwigshafen (DE); Universiteit Gent, Ghent (BE); VIB vzw, Ghent (BE)

( * ) Notice: Subject to any disclaimer, the term of this patent is extended or adjusted under 35 U.S.C. 154(b) by 404 days.

(21) Appl. No.: 13/056,534

(22) PCT Filed: Jul. 29, 2009

(86) PCT No.: PCT/EP2009/059790
§ 371 (c)(1),
(2), (4) Date: Mar. 10, 2011

(87) PCT Pub. No.: WO2010/012760
PCT Pub. Date: Feb. 4, 2010

(65) Prior Publication Data
US 2011/0162109 A1  Jun. 30, 2011

Related U.S. Application Data

(60) Provisional application No. 61/085,046, filed on Jul. 31, 2008, provisional application No. 61/085,431, filed on Aug. 1, 2008.

(30) Foreign Application Priority Data

Jul. 31, 2008  (EP) ..................................... 08161514
Jul. 31, 2008  (EP) ..................................... 08161540

(51) Int. Cl.
*C12N 5/14* (2006.01)
*C12N 15/05* (2006.01)
*A01H 1/00* (2006.01)
*A01H 3/00* (2006.01)
*C07K 14/415* (2006.01)
*C12N 15/82* (2006.01)

(52) U.S. Cl.
CPC .......... *C07K 14/415* (2013.01); *C12N 15/8261* (2013.01); *C12N 15/8262* (2013.01); *C12N 15/8271* (2013.01); *C12N 15/8273* (2013.01)

(58) Field of Classification Search
USPC ....................................................... 800/289
See application file for complete search history.

(56) References Cited

U.S. PATENT DOCUMENTS 7,795,028 B2   9/2010  Rietveld et al.
7,829,758 B2  11/2010  Cnops et al.
2004/0078849 A1   4/2004  Rietveld et al.
2004/0123349 A1   6/2004  Xie et al.
2007/0067875 A1*  3/2007  Horvath et al. ............... 800/287
2007/0169219 A1   7/2007  Nadzan et al.
2008/0271208 A1  10/2008  Cnops et al.
2009/0070894 A1   3/2009  Frankard et al.
2009/0328255 A1  12/2009  Rothstein et al.
2011/0078825 A1   3/2011  Cnops et al.

FOREIGN PATENT DOCUMENTS

| CA | 2644675 A1 | 7/2007 |
|---|---|---|
| WO | WO-02/057469 A2 | 7/2002 |
| WO | WO-03/020888 A2 | 3/2003 |
| WO | WO 2006/027310 * | 3/2006 |
| WO | WO-2006/027310 A2 | 3/2006 |
| WO | WO 2007/064724 * | 6/2007 |
| WO | WO-2007/064724 A2 | 6/2007 |
| WO | WO-2007/084385 A2 | 7/2007 |
| WO | WO-2007/143819 A1 | 12/2007 |

OTHER PUBLICATIONS

Fleury et al., The *Arabidopsis thaliana* homolog of yeast BRE1 has a function in cell cycle regulation during early leaf and root growth, 19 Plant Cell, 417-432 at 417 Abstract (2007)).*
Yanhui et al. (The MYB transcription factor superfamily of *Arabidopsis*: expression analysis and phylogenetic comparison with the rice MYB family, 60 Plant Molecular Biology, 107-124 (2006)).*
Ding et al. (A complex genetic interaction between *Arabidopsis thaliana* TOC1 and CCA1/LHY in driving the circadian clock and in output regulation, 176 Genetics, 1501-1510 (2007)).*
Kuo et al. (Natural variation in a subtelomeric region of *Arabidopsis*: implications for the genomics dynamics of a chromosome end, 173 Genetics, 401-417 (2006)).*
Fleury et al., The *Arabidopsis thaliana* Homolog of Yeast BRE1 Has a Function in Cell Cycle Regulation during Early Leaf and Root Growth, 19 Plant Cell, 417-432 (2007).*
Terence A. Brown, Genomes Chapter 7 § 7.1.1; 7.2.1 (Oxford: Wiley-Liss) (2nd ed. 2002) available at http://www.ncbi.nlm.nih.gov/books/NBK21136/).*
(Liu et al., The Absense of Histone H2B Monoubiquitination in the *Arabidopsis* hub1 (rdo4) Mutant Reveals a Role for Chromatin Remodeling in Seed Dormancy, 19 Plant Cell, 433-444 at 435-438, 440-441 (2007, published online Feb. 28, 2007).*

(Continued)

*Primary Examiner* — Cynthia Collins
*Assistant Examiner* — Rebecca Stephens
(74) *Attorney, Agent, or Firm* — Drinker Biddle & Reath LLP

(57) ABSTRACT

The present invention relates generally to the field of molecular biology and concerns a method for improving various economically important growth characteristics in plants. More specifically, the present invention concerns inter alia a method for modifying growth characteristics in plants by modulating expression in a plant of a nucleic acid encoding a HUB1 (Histone Monoubiquitination 1) polypeptide or encoding another protein useful in the methods of the present invention. The modified growth characteristics comprise a modification of light regulated phenotypes, such as modified circadian clock and/or circadian clock responses, or modified plant architecture.

32 Claims, 29 Drawing Sheets

(56) References Cited

OTHER PUBLICATIONS

Stone et al. (Functional analysis of the RING-type Ubiquitin Ligase Family of *Arabidopsis*, 137 Plant Phys., 13-30 (2005).*
Fleury et al. (The *Arabidopsis thaliana* Homolog of Yeast BRE1 Has a Function in Cell Cycle Regulation during Early Leaf and Root Growth, 19 Plant Cell, 417-432 at Abstract (2007)).*
Holtorf, S., et al., "Comparison of Different Constitutive and Inducible Promoters for the Overexpression of Transgenes in *Arabidopsis thaliana*", Plant Molecular Biology, 1995, vol. 29, pp. 637-646.
Barak, S., et al., "All in good time: the *Arabidopsis* circadian clock," Trends in Plant Science, 2000, vol. 5, No. 12, pp. 517-522.
Berna, G., et al., "A Mutational Analysis of Leaf Morphogenesis in *Arabidopsis thaliana*," Genetics, 1999, vol. 152, pp. 729-742.
Chin, L.-S., et al., "Staring, a Novel E3 Ubiquitin-Protein Ligase That Targets Syntaxin 1 for Degradation," Journal of Biological Chemistry, 2002, vol. 277, No. 38, pp. 35071-35079.
"*Arabidopsis thaliana* At2g44950 mRNA complete cds" Database EMBL, Database accession No. BT010360, Aug. 24, 2003.
Fleury, D., et al., "The *Arabidopsis thaliana* Homolog of Yeast *BRE1* Has a Function in Cell Cycle Regulation during Early Leaf and Root Growth," The Plant Cell, 2007, vol. 19, pp. 417-432.
Gardner, M. J., et al., "How plants tell the time," Biochem. J., 2006, vol. 397, pp. 15-24.
Hwang, W. W., et al., "A Conserved RING Finger Protein Required for Histone H2B Monoubiquitination and Cell Size Control," Molecular Cell, 2003, vol. 11, pp. 261-266.
Karimi, M., et al., "GATEWAY vectors for *Agrobacterium*-mediated plant transformation," Trends in Plant Science, 2002, vol. 7, No. 5, pp. 193-195.
Laukens, K., et al., "Construction of a two-dimensional gel electrophoresis protein database for the *Nicotiana tabacum* cv. Bright Yellow-2 cell suspension culture," Proteomics, 2004, vol. 4, pp. 720-727.
Liu, Y., et al., "The Absence of Histone H2B Monoubiquitination in the *Arabidopsis hub1* (*rdo4*) Mutant Reveals a Role for Chromatin Remodeling in Seed Dormancy," The Plant Cell, 2007, vol. 19, pp. 433-444.
Lorick, K. L., et al., "RING fingers mediate ubiquitin-conjugating enzyme (E2)-dependent ubiquitination," Proc. Natl. Acad. Sci. USA, 1999, vol. 96, pp. 11364-11369.

Maere, S., et al., "BiNGO: a Cytoscape plugin to assess over-representation of Gene Ontology categories in Biological Networks," Bioinformatics Applications Note, 2005, vol. 21, No. 16, pp. 3448-3449.
McClung, C. R., "Plant Circadian Rhythms," The Plant Cell, 2006, vol. 18, pp. 792-803.
McNellis, T. W., et al., "Overexpression of *Arabidopsis* COP1 Results in Partial Suppression of Light-Mediated Development: Evidence for a Light-Inactivable Repressor of Photomorphogenesis," The Plant Cell, 1994, vol. 6, pp. 1391-1400.
Peeters, A. J. M., et al., "Characterization of mutants with reduced seed dormancy at two novel *rdo* loci and a further characterization of *rdo1* and *rdo2* in *Arabidopsis*," Physiologia Plantarum, 2002, vol. 115, pp. 604-612.
Puig, O., et al., "The Tandem Affinity Purification (TAP) Method: A General Procedure of Protein Complex Purification," Methods, 2001, vol. 24, pp. 218-229.
Stone, S. L., et al., "Functional Analysis of the RING-Type Ubiquitin Ligase Family of *Arabidopsis*," Plant Physiology, 2005, vol. 137, pp. 13-30.
Thomson, J. Q., et al., "Site-Specific Recombination Systems for the Genetic Manipulation of Eukaryotic Genomes," Genesis, 2006, vol. 44, pp. 465-476.
Van Leene, J., et al., "A Tandem Affinity Purification-based Technology Platform to Study the Cell Cycle Interactome in *Arabidopsis thaliana*," Molecular & Cellular Proteomics, 2007, vol. 6.7, pp. 1226-1238.
Van Leene, J., et al., "Boosting tandem affinity purification of plant protein complexes," Trends in Plant Science, 2008, vol. 13, No. 10, pp. 517-520.
Xiao, T., et al., "Histone H2B Ubiquitylation is Associated with Elongating RNA Polymerase II," Molecular and Cellular Biology, 2005, vol. 25, No. 2, pp. 637-651.
Zhu, B., et al., "Monoubiquitination of Human Histone H2B: The Factors Involved and Their Roles in *HOX* Gene Regulation," Molecular Cell, 2005, vol. 20, pp. 601-611.
Harmer, "The Circadian System in Higher Plants", *Annu. Rev. Plant Biol.*, vol. 60, pp. 357-377 (2009).
Inzé et al., "Cell Cycle Regulation in Plant Development", *Annu. Rev. Genet.*, vol. 40, pp. 77-105 (2006).

* cited by examiner

MASTGEPDRKRRHFSSISPSEAAAAVKKQPFFWPSSEDKLDTAVLQFQNLKLSQKLEAQQVECSIL
EDKLSQIKEKQLPYNSSLKTVHKSWEKLTASVESCSVRVSDSSSGAHRFVNKEDGSSPAVKNDFIN
RLLETGATESSSSNICSNQMEENGVNTSSQMTQTLYNLVAATEDLRCLKDELYPTVLRTNLGKDLC
GQLALSELESEIKSFRGDLDDVLVKFKSLSRELQSHRDADAKVRVDLKRIRGELEDEVVELQQCNG
DLSALRAERDATAGAFFPVLSLGNKLATSDRERDKQRDLQDMETVLKELTVLASGRLQQLKNLHEE
RTKMLGKMSNLQNKSKSVRCISSSQACLSLKDQLEKSKEAVFQYMALLEKLQVEKDSIVWKEREIN
IKNELGDVSRKTSAVTDSRMASLDSEIQKQLDEKMRIKTRLGNISRERGRKEIFADMKALISSFPE
EMSSMRSQLNNYKETAGGIHSLRADVQSLSGVLCRKTKEYEALQLRSADYASQLGDLNATVCDLKN
SHEELKLFLDMYKRESTDARDIAEAKEQEYRAWAHVQSLKSSLDEQNLELRVKAANEAEAVSQQML
AAAEAEIADLRQKMDDCKRDVAKHSDILKSKHEEHGTYLSEIQTIGSAYEDIVPQNQRLLLQVTER
DDYNIKLFLEGITSRQMQDTLLIDKYIMDKDIQQGSAYASFLSKKSSRIEDQLRFCTDQFQKLAED
KYQKSVSLENLQKKRADIGNGLEQARSRLEESHSKVEQSRLDYGALELELEIERFNRRRIEEEMEI
AKKKVSRLRSLIEGSSAIQKLRQELSEFKEILK**CKACNDRPKEVVITKCYHLFCNPCVQKLTGTRQ
KKCPTC**SASFGPNDIKPIYI

FIG. 1 A

B (i)
Cys-$X_2$-Cys-$X_{11}$-Cys-$X_1$-His-$X_2$-Cys-$X_2$-Cys-$X_{11}$-Cys-$X_2$-Cys
  1.      2.        3.      4.    5.     6.    7.        8.

(ii)
MUTAGENESIS                          AGT        AGC
DNA: CTCAGTGAATTTAAAGAAATTCTGAAG*TGT*AAGGCC*TGC*AACGATCGCCCA
aa:   L   S   E   F   K   E   I   L   K   <u>C</u>   K   A   <u>C</u>   N   D   R   P

DNA: AAAGAGGTGGTGATTACGAAGTGCTACCATTTGTTCTGCAACCCATGTGTG
aa:   K   E   V   V   I   T   K   <u>C</u>   Y   <u>H</u>   L   F   <u>C</u>   N   P   <u>C</u>   V

DNA: CAAAAGCTCACAGGAACTCGACAAAAGAAGTGTCCAACATGCTCAGCAAGT
aa:   Q   K   L   T   G   T   R   Q   K   K   <u>C</u>   P   T   <u>C</u>   S   A   S

DNA: TTTGGACCAAATGATATTAAACCTATCTACATATGA
aa:   F   G   P   N   D   K   P   I   Y   I   *

(iii)
Ser-$X_2$-Ser-$X_{11}$-Cys-$X_1$-His-$X_2$-Cys-$X_2$-Cys-$X_{11}$-Cys-$X_2$-Cys
  1.      2.        3.      4.    5.     6.    7.        8.

FIG. 1 B

CLUSTAL 2.0.3 multiple sequence alignment, (CAO22034 limited to the C-terminal part with the RING domain):

```
XP_001754625       ------------------------------------------------------------
XP_001777122       ------------------------------------------------------------
EDQ74097           ------------------------------------------------------------
CAO22034           LLVMIGSSYHMSAELFRHYRFDPDGTIPSPYLRNFEHASIGITFIIYSSSAIVLDFVAAK
AAG51572           -------------------------------MENQESDEP------MQKKPHLLDSVSPN
ABB47997           ------------------------------------------------------------
LOC_Os04g46450     ------------------------------------------------------------
CAD41603           ------------------------------------------------------------
At2g44950          ------------------------------------------------------------
AAL91211           ------------------------------------------------------------
scaff_40.53        ------------------------------------------------------------
CAO70576           ------------------------------------------------------------
TA45131_4081       ------------------------------------------------------------
AC144591           ------------------------------------------------------------
ABE92765           ------------------------------------------------------------
BAB14005           ------------------------------------------------------------
AAH18647           ------------------------------------------------------------
AAF50744           ------------------------------------------------------------
AAK21443           ------------------------------------------------------------
CAA98640           ------------------------------------------------------------
NP_587845          ------------------------------------------------------------

XP_001754625       ------------------------------------------------------------
XP_001777122       ------------------------------------------------------------
EDQ74097           ------------------------------------------------------------
CAO22034           AKYGLTQLLAAVALGQQLLMFRLHSADHAGLEGQYHLFLQILTLVSTATSLMAIGFPKSF
AAG51572           S---------------MARNSSPSHP----------------------------------
ABB47997           ------------------------------------------------------------
LOC_Os04g46450     ------------------------------------------------------------
CAD41603           ------------------------------------------------------------
At2g44950          ------------------------------------------------------------
AAL91211           ------------------------------------------------------------
scaff_40.53        ------------------------------------------------------------
CAO70576           ------------------------------------------------------------
TA45131_4081       ------------------------------------------------------------
AC144591           ------------------------------------------------------------
ABE92765           ------------------------------------------------------------
BAB14005           ------------------------------------------------------------
AAH18647           ------------------------------------------------------------
AAF50744           ------------------------------------------------------------
AAK21443           ------------------------------------------------------------
CAA98640           ------------------------------------------------------------
NP_587845          ------------------------------------------------------------
```

FIG. 2

```
XP_001754625     ---------------------------------------------MGSTEEPD
XP_001777122     ---------------------------------------------MGSTEDSD
EDQ74097         --------------------------------------------------------
CAO22034         ILGFSRSLCIIFLGVWLMATGVMLWTPGFIPKGCSLLWDEGHQEARCHDDESLHRAKALI
AAG51572         --------------------------------------------------IAKSVSFF
ABB47997         --------------------------------------------------------
LOC_Os04g46450   -----------------------------------------MGSTGEPDRKRR
CAD41603         -----------------------------------------MGSTGEPDRKRR
At2g44950        -----------------------------------------MASTGEPDRKRR
AAL91211         -----------------------------------------MASTGEPDRKRR
scaff_40.53      -----------------------------------------MGSTGEPDRKRR
CAO70576         -----------------------------------------MGSTGEPDRKRR
TA45131_4081     --------------------------------------------------------
AC144591         --------------------------------------------------------
ABE92765         --------------------------------------------------------
BAB14005         --------------------------------------------------------
AAH18647         -------------------------------------MSGPGNKRAAGDGGSGP
AAF50744         ---------------------------------------MSKRSADDATG--SSCL
AAK21443         ----------------------------------------MMKRSNEGIGGENYA
CAA98640         --------------------------------------------------------
NP_587845        --------------------------------------------------------

XP_001754625     RKRRHLNKDHLASPPVKKQPHTPSSEEKKVDAQMLQFQNHKLAQQLYVQRNEINVLEGKL
XP_001777122     RKRRNFN--HSVSPVVMKQSLTPSSEKKKVDAQMLHYQNSKLSQLLEVQRNEINVLEGKL
EDQ74097         ----------------------------MLQFQNQKLAQQLDHQRSEISSLENRC
CAO22034         NIEFSWYLIAIMIFSVSFYLFLVDAYGDKVDATYLQYQNQKLVQQLEVQKHELHDLEDKI
AAG51572         DCDFSLLCLRLVDYEI-----------DVDATVLQLQNQKLVQQLDLQKKQLYDVESKI
ABB47997         ------------------------------MDAAALQYENQKLVQQLEAQKSKMRALEGKF
LOC_Os04g46450   LSSSVAPGGGAPVSPAKRLAVAPTSEDKKLDFTVLKYKNQKLSEQLEAHKFEYRALENKF
CAD41603         LSSSVAPGGGAPVSPAKRLAVAPTSEDKKLDFTVLKYKNQKLSEQLEAHKFEYRALENKF
At2g44950        HFSSISPSEAAAA--VKKQPFFWPSSEDKLDTAVLQFQNLKLSQKLEAQQVECSILEDKL
AAL91211         HFSSISPSEAAAA--VKKQPFFWPSSEDKLDTAVLQFQNLKLSQKLEAQQVECSILEDKL
scaff_40.53      HFSSISS-PTAAM--AKKQPLSHLSEDKKLDTAVLQYQNQKLQQKLEAQKVEHSALENKF
CAO70576         HFSSLS--PTAAT--AKKMPFLPVSEDKKLDTAVLQYQNQKLKQKLEAQKVECSALENKF
TA45131_4081     --------------------------------------------------------
AC144591         --------------------------------------------------------
ABE92765         --------------------------------------------------------
BAB14005         --------------------------------------------------------
AAH18647         PEKKLSREEKTTTTLIEPIRLGGISSTEEMDLKVLQFKNKKLAERLEQRQACEDELRERI
AAF50744         VAAAAAGQPPIKKVHFEPHLIGPVSTLEEMDIKVLEFQNKKLAQRIEQRMRTEAELRHRI
AAK21443         SSPSDDGQQKRRKIQFEPVRMPAVSNVNDIRARAVVYQTSKLKQQLLYKNKRIAELEKEN
CAA98640         --------------------------------------------------------
NP_587845        --------------------------------------------------------
```

FIG. 2 (continued)

```
XP_001754625    NQLLSNQASFDDNLSKVSRVWNQVVDDLESLTVRY-----------------------------
XP_001777122    NQLHNKQVSFDENLSIVSRVWDQVVDDLELLTVRV-----------------------------
EDQ74097        CQLKGKQASYDDTLITVNRTWNLLEDDLELLAVRA-----------------------------
CAO22034        KELKDRQTSYDDMLITMNQLWSQLVDDLILLGVRA-----------------------------
AAG51572        QELQLNQTSYDDELISVNQLWNQLVDDLILLGVRA-----------------------------
ABB47997        KELRDEQCSYDNTLICLNKMWNQLIDDLVLLGVRA-----------------------------
LOC_Os04g46450  AGLKEKQRTHNETLSLVNSSWEQLVADLKSRSFCK-----------------------------
CAD41603        AGLKEKQRTHNETLSLVNSSWEQLVADLKSRSFCK-----------------------------
At2g44950       SQIKEKQLPYNSSLKTVHKSWEKLTASVESCSVRV-----------------------------
AAL91211        SQIKEKQLPYNSSLKTVHKSWEKLTASVESCSVRV-----------------------------
scaff_40.53     SLQKEKQKPYNSTLKAVNKSWEVLVTDLETCSNRT-----------------------------
CAO70576        SQLKETQQSYNTTLTLVNKTWRELVDNLETCSVHL-----------------------------
TA45131_4081    ----------------------------------------------------------------
AC144591        ----------------------------------------------------------------
ABE92765        ----------------------------------------------------------------
BAB14005        ----------------------------------------------------------------
AAH18647        EKLEKRQATDDATLLIVNRYWAQLDETVEALLRCHESQGELSSAPEAPGTQEGPTCDGTP
AAF50744        EQLEKRQTQDDAVLNVVNRYWNQLNEDIRVLLQR--FDAETADELENRNENEVTTSFLAQ
AAK21443        ERSKRRQQTDESNFLKVYNMFSDIEKYICT----------------------------------
CAA98640        ----------------------------------------------------------------
NP_587845       ----------------------------------------------------------------

XP_001754625    ----------------------------------------------------
XP_001777122    ----------------------------------------------------
EDQ74097        ----------------------------------------------------
CAO22034        ----------------------------------------------------
AAG51572        ----------------------------------------------------
ABB47997        ----------------------------------------------------
LOC_Os04g46450  ----------------------------------------------------
CAD41603        ----------------------------------------------------
At2g44950       ----------------------------------------------------
AAL91211        ----------------------------------------------------
scaff_40.53     ----------------------------------------------------
CAO70576        ----------------------------------------------------
TA45131_4081    ----------------------------------------------------
AC144591        ----------------------------------------------------
ABE92765        ----------------------------------------------------
BAB14005        ----------------------------------------------------
AAH18647        LPEPGTSELRDPLLMQLRP-PLSEPALAFVVALGASSSEEVELELQGRMEFSKAAVSRVV
AAF50744        LSTWDKEELDEKLANRVQVSKRAVAKIVQVIDRLMQRNEKITHVLKGDSLASAGSGSGAG
AAK21443        ----------------------------------------------------
CAA98640        ----------------------------------------------------
NP_587845       ----------------------------------------------------
```

FIG. 2 (continued)

```
XP_001754625        -----------------SSSSNGTYLLEPASNDRN-NSSVSSEQTFLQRFLDNGATGSS
XP_001777122        -----------------GPTSNGTHALG-SPHDRD-NASFRPEQTFLQRLLDRGATDNS
EDQ74097            -----------------NANTNGLRVLEPVPTNK--GPAVPPEETFLQRLLDKGATESS
CAO22034            -----------------GGGQNAIQTLDHADHSRGLIPSCPAEEIFLCRLLETDSVESN
AAG51572            -----------------GANQEALNYLDIVDKKR--VPPCAADETFLCRLLQVDSLDTS
ABB47997            -----------------GGDLNGLQALDHEEMSEESLESCPSEEIFLFRLLNSRNFRNN
LOC_Os04g46450      -----------------SGSPNSSPGSGHNNVQKD-GTCAPIERDTLRSLVESGATESS
CAD41603            -----------------SGSPNSSPGSGHNNVQKD-GTCAPIERDTLRSLVESGATESS
At2g44950           -----------------SDS-SSG--AHRFVNKED-GSSPAVKNDFINRLLETGATESS
AAL91211            -----------------SDS-SSG--AHRFVNKED-GSSPAVKNDFINRLLETGATESS
scaff_40.53         -----------------REW-INGQDVKHVPIARD-GGSSSLKDAFLSRLMETGATESS
CAO70576            -----------------KDS-ASAGRHVKLPSTTE-DGNSCLQDAFLSRLIETGATESC
TA45131_4081        ------------------------------------------------------------
AC144591            ------------------------------------------------------------
ABE92765            ------------------------------------------------------------
BAB14005            -----------------------------------------MRLQELTDLLQEKHRTMSQ
AAH18647            EASDRLQRRVEELCQRVYSRGDSEPLSEAAQAHTRELGRENRRLQDLATQLQEKHHRISL
AAF50744            AGGEEEQQQASGDAETTTSSAGVHALEETLKQTHIEIMSENHKLQNLNTSLHEKFHTMSL
AAK21443            -----------------QTKNEFGEYIGGDTAPTGIDVLGMTNETYNKFFDQAKQNLR
CAA98640            ------------------------------------------------------------
NP_587845           ------------------------------------------------------------

XP_001754625        TTNGSN--DFVKSGLCSQQTSTAEILKLLVQSIDYEQVRNEELLSTFLNGIASNAV----
XP_001777122        TINRSN--GSVESGLFSRKADIAMTVTYLVQSIDYERARNDELVSSLRNDIASIGV----
EDQ74097            NCEGSISLSAVEAGLASRKAATMKTMKYLLLAIETQRSKNDELAMSLQN-IVSPHE----
CAO22034            GNDGIV--KYVEEALALRHSSTLELIKSLEDTIDAQRVKTENIAQALHG-KLSAED----
AAG51572            KSDEVV--RKVEEALALRHSSTMELMGLFENTIDTQKTKAESISQSLHA-VKSTED----
ABB47997            DDSSLS--KLVEEALALRYSTTVTLMKSLQEAFAVQQARSESLSLALNG-QNSSED----
LOC_Os04g46450      GCLPG----CHLGSDAPPLHLSTANALGDIFFPSSDLLQANEECALAALTKLPENDRS---
CAD41603            GCLPG---CHLGSDAPPLHLSTANALGDIFFPSSDLLQANEECALAALTKLPENDRS---
At2g44950           SSNICS--NQMEENGVNTSSQMTQTLYNLVAATEDLRCLKDELYPTVLRTNLGKD-----
AAL91211            SSNICS--NQMEENGVNTSSQMTQTLYNLVAATEDLRCLKDELYPTVLRTNLGKD-----
scaff_40.53         SATNCP--DQMEVDRETAFEKNKRIAHNLVATINGLWYLKDGLRAAVLKQLTEDGRSILP
CAO70576            SANDFS--DRMEEDRPTSCGKTKNSLSNIVSTINDLWCLKDGLYAAVLEALPEDG-----
TA45131_4081        ------------------------------------------------------------
AC144591            ------------------------------------------------------------
ABE92765            ------------------------------------------------------------
BAB14005            EFSKLQSKVETAESRVSVLESMIDDLQWDIDKIRKREQRLNRHLAEVLERVNSKGYKVYG
AAH18647            EYSELQDKVTSAETKVLEMETTVEDLQWDIEKLRKREQKLNKHLAEBALEQLNS-GYYVSG
AAF50744            KMKEYQDAHTAKETENAELKNQIDELQYDLEKIHCRNDKLENHLAEAIEKLKA-YHQIYG
AAK21443            N--AFVSYAKARHDRAHESTIFIDKLKTLIDSPTFNPNGVHKELTAKAASLAIQNE----
CAA98640            ---------------MTAEPATKKIKLELSDPSEPLTQSDVIAFQKEALFRCINR----
NP_587845           ---------------MYQNGKPDAPTILGQKRELEDVEIQDD------------------
```

FIG. 2 (continued)

```
XP_001754625    ------------------------NLLPLVKEDEELYAETKKLRSLVDGFHLKHRELSA
XP_001777122    ------------------------NGS-LAKADEELYAEAKKVRGFVEDLHLKHRQLSA
EDQ74097        ------------------------AGRILEESNDELRMEITNIRGVMDLLQLNHKEMSA
CAO22034        ------------------------AIIQLSKIDDLMKEEANNLREVIDALHLKHKEYVD
AAG51572        ------------------------ATIQLSSINDLMKEESKNLREMIDALHVRHKEHSE
ABB47997        ------------------------VIVALENHNDYLKEVVDNLRQAVSIINRKHEKYLD
LOC_Os04g46450  ------------------------KQLQSTSSNLLSSLNNVVQALSNLQLKHKQLAE
CAD41603        ------------------------KQLQSTSSNLLSSLNNVVQALSNLQLKHKQLAE
At2g44950       ------------------------LCGQLALSELESEIKSFRGDLDDVLVKFKSLSR
AAL91211        ------------------------LCGQLALSELESEIKSFRGDLDDVLVKFKSLSR
scaff_40.53     QVSVLYLSWATSFRVFSVPMYVSPLLDACRETISNELETELKNLRLGLSDLHLKHKSLAR
CAO70576        ------------------------LCNKKISSDLHAEVNNMRLAFGDLHLKHKSVTR
TA45131_4081    ------------------------------------------------------------
AC144591        ------------------------------------------------------------
ABE92765        ------------------------------------------------------------
BAB14005        ----------------AGSSLYGGTITINARKFEEMNAELEENKELAQNRLCELEKLRQ
AAH18647        ----------------SSSGFQGGQITLSMQKFEMLNAELEENQELANSRMAELEKLQA
AAF50744        DPNK-----STNSAKTPTTTGSGGATTSVNSQLLEELQKELEEYRELANNRLQELDKLHA
AAK21443        ------------------------------KLQSEVTKVQSDCYNLERKKRILTD
CAA98640        ------------------------------RRVDFEALRKQYELSRRECIDVSR
NP_587845       ------------------------------DIQEVSKEDLLKDVRVRSIQFDELES XP_001754625    ELGTCHDFQAKDRAELKRLKDELEEACADLEGVRHQLAALRSE-NVILSGPPTPSATLTS
XP_001777122    ELGTCGDFQAKDQAEVKRLKGELEEVCADLEANRRQLTAFRSQ-DATLSGSATPSATPTR
EDQ74097        EIGIARDLQTKDQSDIKRLTGELEETAADLEMCRRKLATLRSQKEAAAVAPPTVGTPKLG
CAO22034        GIQTYVHSHSVDQSEIKRLAGELEESMAELEESRRKLVNLKMQKDVASVVHTPVQGAVNG
AAG51572        QIQAYISSHSTDQSELKHLKGQLEEIKAELEENRRKLITLKMQKDAACEGHVTSPAIANG
ABB47997        EIEAFKNNQSRELHEVKCLSGELEESMAELEESRRKLAVLQLQTGGGSLMNTSAPNGVNG
LOC_Os04g46450  DYQNQRDSSARKRAEHRRLKEELASAASELEETNYKLAALKAQRDNTQGARIPYPTLGNK
CAD41603        DYQNQRDSSARKRAEHRRLKEELASAASELEETNYKLAALKAQRDNTQGARIPYPTLGNK
At2g44950       ELQSHRDADAKVRVDLKRIRGELEDEVVELQQCNGDLSALRAERDATAGAFFPVLSLGNK
AAL91211        ELQSHRDADAKVRVDLKRIRGELEDEVVELQQCNGDLSALRAERDATAGAFFPVLSLGNK
scaff_40.53     ELQNHRDSDAKNKAELKHLKGELETTVAELNDSNCKLATLKAERNATKGAFFPVLNMGSK
CAO70576        DMQSHRDIDAKNKAELKRLRGELESTVAELEESNCKLVTLKAERDAAKGAFFPILSLGSK
TA45131_4081    ------------------------------ASCRFGTR---------------
AC144591        ------------------------------MYRLCIL---------------
ABE92765        ------------------------------MYRLCIL---------------
BAB14005        DFEEVTTQNEKLKVELRSAVEQVVKETPEYRCMQSQFSVLYNESLQLKAHLDEARTLLHG
AAH18647        ELQGAVRTNERLKVALRSLPEEVVRETGEYRMLQAQFSLLYNESLQVKTQLDEARGLLLA
AAF50744        THRETLKEVEKLKMDIRQLPESVIVETTEYKCLQSQFSVLYNESMQIKTMLDETRNQLQT
AAK21443        KLSVQENRVQELEHQLEDARFETDKHMRLANKFEYKLATLVSEGQSGGNGGATPSSSGTT
CAA98640        KLANIMALIVTLARFIETFCTDANEKQLCREIAQGDETLIVQRSDSFMKLLTKYGKPNTT
NP_587845       KIEGLQNLAEEKLKVLATLVSWWPEILQQFSVVFQGNELKDFESEGVFSILEKFPELSYF
```

FIG. 2 (continued)

```
XP_001754625    NKFEFGDGGASQEKVSKECCQLEADLEEVKTLAARRLMELQEALQNHLDVIKKFQHMQNE
XP_001777122    KMFEVREGDAEQGKFPEENCELETGLEEAKSLAARSLTELQEAMHNHLDDIRKIQQMQVR
EDQ74097        VKNEVGDRVPGADKASREARELEAALEETKTLASIRLNELQDALQTQLNLSQRLQHMKDA
CAO22034        SLSPEKHADRTMG-----FRELKDSVEETKILAADRLSELHEAQEDNLILSKQLQDLQNE
AAG51572        SLSPEKPVDKTK------LRELKDSIDEIKIMAEGRLSELQASQEYNLSLSRQCQDIENE
ABB47997        SVSTDKSSDKGMG-----WRDLKDAVEEAKTLAANRLFELHETQEDNLILSKQLEDIQDQ
LOC_Os04g46450  NMPEDKVRDKQREMQDLEATHKELSELISK-----RLVEIKRLHEERIEILNKIATFQNI
CAD41603        NMPEDK-----------------ELISK-----RLVEIKRLHEERIEILNKIATFQNI
At2g44950       LATSDRERDKQRDLQDMETVLK---ELTVL--ASGRLQQLKNLHEERTKMLGKMSNLQNK
AAL91211        LATSDRERDKQRDLQDMETVLK---ELTVL--ASGRLQQLKNLHEERTKMLGKMSNLQNK
scaff_40.53     HAAGDQVRDKQKDLQBEMESAVK---ELLDQ--ASSRLQELKDLHEERLKILQKLSNLQNL
CAO70576        NVAGDKARDKQKDLHDMEATLK---ELLDQ--SSSRLLELKALYEERIGILKQLSNLQNT
TA45131_4081    --ANDKARDKQRDMQDMESTLK---EYLDQ--SSFRLFELKRLHEERIDILKQLSNLQNK
AC144591        -LTYPTLFRVATAYWIPYHVPK---RIVN--------------------------QNT
ABE92765        -LTYPTLFRVATAYWIPYHVPK---RIVNQCWTGQKMQKVTGKRGWSDSAMEGKLSHENT
BAB14005        TRGTHQHQVELIERDEVSLHKK----LRTEVIQLEDTLAQVRKEYEMLRIEFEQTLAANE
AAH18647        TKNSHLRHIEHMESDELGLQKK----LRTEVIQLEDTLAQVRKEYEMLRIEFEQNLAANE
AAF50744        SKNQHLRQIEVMESEELIAQKK----VRSEMIQMEDVLALIRKEYETLRIEFEQNMAANE
AAK21443        NATEKKISAPDIP--------------------PSETAAKEIENLRLERDEQESIAS
CAA98640        DSNTNSNAS------------------------DHIQELTTELKNLRKSKEELFYENS
NP_587845       NDAVKNNKTKALS-------------------IIQKLLSTVDSSTNSVSRDPFSVLSI XP_001754625    LDDQERIVSSRQYQSLTEQVQHLRSEVERYRAMVDQLQGEHVSLLRREKEIALKTEAGDA
XP_001777122    FAS-IFIISFRQYQSLDEQVQYLRTEVEKYRAVVDELQVERVSLVRQEKEVILKAEAGDA
EDQ74097        LHDEHRILSSRPYLLLNDQAQFLKGEVERYRGLADKLQSDRDAMSRREKEVLLKAEAGEA
CAO22034        LKDDKYVYSSRPYTLLNDQLQHWNAEAERYKLLTDSLQADRAQVVRREKELNAKSELADA
AAG51572        LKDDQYIYSSRLYSLINDRIHHWNAELDRYKILTEAIQAERSFVMRRDKELNLRAESLEA
ABB47997        LKDENYIVTSKPYTILSDQLHHLNAEIERYRGLVEVLQNEKDQLMQKEEEMLAKAESVDA
LOC_Os04g46450  LMDFKSIRSSKAFQLVNDRLQKSQAELDIHYQTLLEKLQVDKDKFVWQERQFNLKVDLAEI
CAD41603        LMDFKSIRSSKAFQLVNDRLQKSQAELDHYQTLLEKLQVDKDKFVWQERQFNLKVDLAEI
At2g44950       SKSVRCISSSQACLSLKDQLEKSKEAVFQYMALLEKLQVEKDSIVWKEREINIKNELGDV
AAL91211        SKSVRCISSSQACLSLKDQLEKSKEAVFQYMALLEKLQVEKDSIVWKEREINIKNELGDV
scaff_40.53     LKNVKSISSSRAYLLVRDQLEKSKSMVLHYRALFEKLQVEKDNLVWKERELNMKNDLVDV
CAO70576        LKNVKCISSSSAYVLVTDQLEKSKAEVVHYQALFEKLQVEKDNLVWREKEVNMKNDFVDV
TA45131_4081    LKNLKAICSSQPYILVKDQLAKAKEDLSLYQSLYEKLQVEKDNLSWREKEMNLKNDITDV
AC144591        LKNLKCITSSHAFQLVRDQTEKSKSEVQEYQALYEKLQAEKDSLTWREREWYIKNDLADL
ABE92765        LKNLKCITSSHAFQLVRDQTEKSKSEVQEYQALYEKLQAEKDSLTWREREWYIKNDLADL
BAB14005        QAGPINREMRHLISSLQNHNHQLKGEVLRYKRKLREAQSDLNKTRLRSGSALLQSQ----
AAH18647        QAGPINREMRHLISSLQNHNHQLKGDAQRYKRKLREVQAEIGKLRAQASGSAHSTPNLGH
AAF50744        QTAPINREMRHLITSLQNHNGQLKGEVQRYKRKYKDTSTDNLKLRQELADALATLGENKL
AAK21443        RRLQDLEEMNKKVQTLTQENSKLRLETQTFFSVDSIVNSEEYKN-LKKYYSLAIKEYERV
CAA98640        QLTEEISALKEYYTNIIRKYD--RDESFTIKRVFKEDKTDAVKELREDEKESNENNIKSG
NP_587845       DDSALTEKLNTINLDIDKILDELDTTRSQLHSIIKLPDRSSSFTLQCINESVRPQSTKVK
                                                :                     . .
```

FIG. 2 (continued)

```
XP_001754625    AQKASTTSDDRAAALELKLRQCMSDCDSLRLRVEGATHASGVKESVADLEKVITSLHKDM
XP_001777122    ARRAGAISDARAADLELKLQQCMSDCDTMRLRIEDATRASGVKESVADLKKESTNLHEDM
EDQ74097        ARKASAIADARAAEIETKLQECLADRDVLQFRLEEVGQSSGRKDSVPELQVMISTLHKEM
CAO22034        ARSVIEND-SKIEELELQLQKCLIEKNDLEVKMKEALQDSGRKDIKAEFHVMASALSKEM
AAG51572        ANHKTTTVGSRIEVLEKKLQSCIIEKNGLELETEEAIQDSERQDIKSEFIAMASTLSKEM
ABB47997        VQQSITTYKAKIEDLEHEIQKLMAEKNDLEIKAEEALQDSGKKDFKDEIHVMAASLSKEM
LOC_Os04g46450  PERVSTYCESSIADLKKDIQKLCDEKNMLILKLEEASREPGRNQVITKFKALVSSIPREM
CAD41603        PERVSTYCR------------------------------NQVITKFKALVSSIPREM
At2g44950       SRKTSAVTDSRMASLDSEIQKQLDEKMRIKTRLGNISRERGRKEIFADMKALISSFPEEM
AAL91211        SRKTSAVTDSRMASLDSEIQKQLDEKMRIKTRLGNISRERGRKEIFADMKALISSFPEEM
scaff_40.53     CRRSTAVVDSRVADLGKEIQKQINERNMIETNLEESSREPGRKDVIAEFKALVSSFPEEM
CAO70576        FRRSSVVTDSRLSELRIEIQNQINERNLIEIKLEEASREPGRKEIIAEFKALLSSFPDNM
TA45131_4081    FRRSSTIADSRIAWLEKEMQKHMQERNMIEGKLEEASREPGRKEIIAEFKKLVSSFPETM
AC144591        FQRSVEVSDLKVADIRTELRKTIEQRDVIENKLKEEAREPGRKEIIAEFKSLLSSFPEEM
ABE92765        FQRSVEVSDLKVADIRTELRKTIEQRDVIENKLKEEAREPGRKEIIAEFKSLLSSFPEEM
BAB14005        ------SSTEDPKDE----PAELKPDSEDLSSQS-SASKASQE----DANEIKSKRDEEE
AAH18647        PEDSGVSAPAPGKEEGGPGPVSTPDNRKEMAPVPGTTTTTSV----KKEELVPSEEDFQ
AAF50744        QAATG-AAGEEIKQENSTGVKEENSNNVSASGQTNQTNSGNDTNVAIKEENHISAEDEAD
AAK21443        SKDLEDITTERDAFRSAKEARAMLMSEEHQKTLKEIQCQSDIHNSFYKVSHDSEVLRCEF
CAA98640        NKDSSAINGDNTSKKSEKGDELVQAEDERKEDAENEKLELDLK--FSDLRAEINSLSSTI
NP_587845       EEATTSSKGKDEEKKVSTVEQRTQLQQLSRLQDQQNGLMESRSQSLKILDSNVNEMDKLI XP_001754625    SMMQAQLF----------------EYKEAGSAVFSLRAELHSLRAIIDRK--VSKHFCD
XP_001777122    NMIQTQLD----------------DFKETGSAVHSLRAKLHSLHLILERKTLESRLLSD
EDQ74097        GMMQAQLN----------------KFKEAACEVQSLRAEIHSLAGILERKTLECTRLSD
CAO22034        GMMESQLN----------------RWKETAHEALSLREQVQSLKALLNKKTNEQKCLAD
AAG51572        EMMEAQLK----------------RWKDTAQDALYLREQAQSLRVSLSNKADEQKGLED
ABB47997        ELLDNQMN----------------RSKDAASEALALREEADYLRTLLAKKIDEQKEISD
LOC_Os04g46450  GAMQSEMT----------------KHKEASLELNSLRAEVHSLSRILSRKERDNEEASC
CAD41603        GAMQSEMT----------------KHKEASLELNSLRAEVHSLSRILSRKERDNEEASC
At2g44950       SSMRSQLN----------------NYKETAGGIHSLRADVQSLSGVLCRKTKEYEALQL
AAL91211        SSMRSQLN----------------NYKETAGGIHSLRADVQSLSGVLCRKTKEYEALQL
scaff_40.53     GSMQSQLS----------------NFKEASSDIHSLRADVQSLSTVLDRK---------
CAO70576        GTMQNQLR----------------KYKEAASDVHSLRADVQSLSSVLERKEKELETLST
TA45131_4081    GDMQNQLS----------------NYKETASDVHSLRTDVQSLSSFLDRKSKEIEALSA
AC144591        GSMQSQLS----------------KYKESASDIHSLRADVHSISSILDQKVKECDALSV
ABE92765        GSMQSQLS----------------KYKESASDIHSLRADVHSISSILDQKVKECDALSV
BAB14005        RERERR-------EKERERERE---REKEKEREREKQKLKES-EKERDSAKDKEKGHDD
AAH18647        GITPGA-------QGPSSRGREPEARPKRELREREGPSLGPPPVASALSRADREKAKVEE
AAF50744        DEASGKDVKDGIKQEKLSSGDAAAAEKKDSPGPGNSTSSATNSVPVKNEKDSKDGVKGKD
AAK21443        ETVKEEYN----------------KTVKQSEWDEMKATLNTLRSMNRSLKSEKIRLRE
CAA98640        KDLENIRR----------------ENEEELIKTRSEVSNLKKQQIAAADQDPDFKSYDHE
NP_587845       MERENALN----------------NVETTNLKKYSSFLALKEAVSMTSEQLRVLEHLLS
```

FIG. 2 (continued)

```
XP_001754625    TSAKRSTRISVCNLQFRV-LRGSEKELKLIFDMYNKESNDSS-----EMRKLQQEECRAQ
XP_001777122    QYAGQVRELNFIQDEVCLGLRDSEKELKLILDMYDRELSDPR-----EVRELQQADCRAL
EDQ74097        QYVSQVADLIALKSEVEI-LRQSDQELQLILEMYERESTGPR-----NMMELQQDHSRTL
CAO22034        KCEEQMVEIKSLKALIEK-LQKGKLELQIFVDMHGQESYDNR-----DLMEIKESEHKAH
AAG51572        KCAKQMAEIKSLKALIEK-LLKEKLQLQNLASICTRECNDDR-----GLAEIKDSQRKAQ
ABB47997        RYNTQVTEIKSLKALIET-LDQEKQELQFIVDMLGKECSESR-----AISEIEESENRAR
LOC_Os04g46450  RSARAGSDITQLQSVISDLKQTN-KELKLFADMYKRESTDSR-----EIMESRDREFLEW
CAD41603        RSARAGSDITQLQSVISDLKQTN-KELKLFADMYKRESTDSR-----EIMESRDREFLEW
At2g44950       RSADYASQLGDLNATVCDLKNSH-EELKLFLDMYKRESTDAR-----DIAEAKEQEYRAW
AAL91211        RSADYASQLGDLNATVCDLKNSH-EELKLFLDMYKRESTDAR-----DIAEAKEQEYRAW
scaff_40.53     ---------------VQDLNENI-LELKLILDMYQRESTYSR-----DVLEARDLEYKAW
CAO70576        RSADQVADIRKLQALIQDLEESD-IQLKLILEMYRCESVDSR-----DVLEARDKEYKAW
TA45131_4081    KSASQVTEMLKLQAVVNDLKESD-MHLKLILEMYTRESAFSR-----DVFEARSSEYRAW
AC144591        RSAGQLAEINRLLAVVQDLRVTE-DEMKLILRMFRRETIDSRDLCRRDVMEAREAEYIAW
ABE92765        RSAGQLAEINRLLAVVQDLRVTE-DEMKLILRMFRRETIDSR-----DVMEAREAEYIAW
BAB14005        GRKKEAEIIKQLKIELKKAQESQ-KEMKLLLDMYRSAPKEQR-----DKVQLMAAEKKSK
AAH18647        TKRKESELLKGLRAELKKAQESQ-KEMKLLLDMYKSAPKEQR-----DKVQLMAAERKAK
AAF50744        VKAVESETVRDLKAQLKKALNDQ-KEMKLLLLDMYKGVSKDQR----DKVQLMATEKKLR
AAK21443        KDKQSQKDINTLKSELTSLKEAQDKCLLVPLEDVSNAPPEDVN--------------KIR
CAA98640        SLLAKIQHLTEQNAELSEINSSFLSKFQVLAKEKEIYTKKVREEFQKSLDSLVEMNSSLE
NP_587845       ECSHEINVLSQQSKNFNGVFESSYQPLINDLDHQISVMQNDE-----KRINNAKTELSLS XP_001754625    AEMGRLQLALDEHNLELRVKNANEAEAACQQKLAAVEAEIAELRQSLQASYR--------
XP_001777122    AEVKRLQLALDEHNLERRVKDANEAEAACQQKLTAVDAEIAELRQNLDVSYK--------
EDQ74097        VQVERLKRALDEHNLELRVKAANEVKAACEQRLAAAETEISEHRQRLDDSER--------
CAO22034        MQAEVLRNALDEHSLELRVKAANEAEAACQQRLSAAEEAEIADLRAKLDASER--------
AAG51572        AQAEELKNVLDEHFLELRVKAAHETESACQERLATAKAEIAELRTQLDLSER--------
ABB47997        KQAEYLRKCLEEHNLELRVKAANEETACQQRLSIAEAEELEDLRAKVDASER--------
LOC_Os04g46450  AHVHALKSSLDESKLEQRVKAANEAEAITQQRLATAEAEIAESGQKLGTSRK--------
CAD41603        AHVHALKSSLDESKLEQRVKAANEAEAITQQRLATAEAEIAESGQKLGTSRKYRIMLLNI
At2g44950       AHVQSLKSSLDEQNLELRVKAANEAEAVSQQMLAAAEAEIADLRQKMDDCKR--------
AAL91211        AHVQSLKSSLDEQNLELRVKAANEAEAVSQQMLAAAEAEIADLRQKMDDCKR--------
scaff_40.53     AQVQSFKFSLDEQNLELRVKTANEAEAISQQKLAAAEAEIADLRQKLEASKM--------
CAO70576        AHVQSLKSSLNEHSLELRVKTAIEAEALSQQRLAAAEAVIVDLRQKLEASKR--------
TA45131_4081    ARVQSLKTSLDEHNLEVRVKSAIEAEADSQQKLGAAEAELEDLRQKLDASKR--------
AC144591        AHVQTLKSSLDEHNLELRVKTANESEARSQQKLAAAEAEIADMRHNLDDSKR--------
ABE92765        AHVQTLKSSLDEHNLELRVKTANESEARSQQKLAAAEAEIADMRHNLDDSKR--------
BAB14005        AELEDLRQRLKDLEDKEKKENKKMADEDALRKIRAVEEQIEYLQKKLAMAK---------
AAH18647        AEVDELRSRIRELEERDRRESKKIADEDALRRIRQAEEQIEHLQRKLGATK---------
AAF50744        SEIEELRQQLKKLQESKREERKKLADEEALRKIKQLEEQKYELQKQMANHKPTD------
AAK21443        QEYESLCKEVKRLGAMEKQEKQKQVEKEVNRQIADKLSELETLRKTNEMLTN--------
CAA98640        KDVVRIRTARDDLLSKIAILEAEKSKTEVLSDLQHAIDILKEQWTKIDQRSN--------
NP_587845       LEKKLEAKKQKEKVYKDKLDELANLETMVLEKKKAVATREAANKIRLVDLND--------
```

FIG. 2 (continued)

```
XP_001754625      ---------------VSLDLKESLQAKKEEGDPYISEIEAILHAYEDVQTQNQR----LL
XP_001777122      ---------------VAQDLRESLQTKKEEEDTYISEIDDITQAYIDMQIQNRK----LL
EDQ74097          ---------------VVMELKETLKSKSEEGDTYIAEIETIGQAYEEMQTQNSR----LI
CAO22034          ---------------DVLELKEAIRIKDVEAEAYISEIETIGQAYEDMQTQNQH----LL
AAG51572          ---------------EVLELKEGIKVKEQEAEASIAEMETIGQAYEDMQTQNQH----LL
ABB47997          ---------------DVMKLKESIRIKEAEVDGHISEIETIGQAYEDMQTQNQH----LL
LOC_Os04g46450    ---------------DLVSLSHMLKSKQEECEAYRVEVECIGQAYEDIQAQNQQ----LL
CAD41603          VSLRTVEVGVTSLLGDLVSLSHMLKSKQEECEAYRVEVECIGQAYEDIQAQNQQ----LL
At2g44950         ---------------DVAKHSDILKSKHEEHGTYLSEIQTIGSAYEDIVPQNQR----LL
AAL91211          ---------------DVAKHSDILKSKHEEHGTYLSEIQTIGSAYEDIVPQNQQ----LL
scaff_40.53       ---------------DMSRLSDVLESKNEENEAYLSEIETIGQAYDEMQTQNQH----LL
CAO70576          ---------------DMFRLSDVLKSKHEENEAYLSEIETIGQAYDDMQTQNQH----LL
TA45131_4081      ---------------ERSRLSEVLKSKHEETEAYLSEIETIGQAYDMQAQNQQ----LF
AC144591          ---------------ATCKQSDVMRSKNEENEAYLSEIETIGQAYDDMQTQNQH----LL
ABE92765          ---------------ATCKQSDVMRSKNEENEAYLSEIETIGQAYDDMQTQNQH----LL
BAB14005          ------------------------QEEEALLSEMDVTGQAFEDMQEQNIR----LM
AAH18647          ------------------------QEEEALLSEMDVTGQAFEDMQEQNGR----LL
AAF50744          --------NSWGSGAPGTANYTRPFVGSHEEEALLNEMEVTGQAFEDMQEQNSR----LI
AAK21443          ---------------------DEECISDELEAIGTAVEEEQERNAQ----LY
CAA98640          ---------------------DTKSSSTQDALIKEIQDLEKGFRELSDLTHK----KY
NP_587845         ---------------------LELQKDLSTYLSKELASTEKAFRLVKQQTVKSSHSHY
                                         *:             .        . :

XP_001754625      QEIKERDEYNSQL--------------------------MSESLKARQLQFPLQAEKQ
XP_001777122      QEIIERDEYNAQL--------------------------MSDSLKAKQLQTSLQAEKQ
EDQ74097          HQITERDDYNTQL--------------------------VAESLKAKQLQASLQSEKQ
CAO22034          QQVTERDDYNIKL--------------------------VSESVKTKQMQSFLLSEKQ
AAG51572          QQVAERDDYNIKL--------------------------VSESVKTKHAYNTHLSEKQ
ABB47997          QQVADRDDFNIKL--------------------------VSDSVKMKQAYGSLLAEKN
LOC_Os04g46450    QQIIERDDDNTK---------------------------IFMEGVKAKQTDALHLETY
CAD41603          QQIIERDDDNTKDVRFGYIVNLIVPETQYFIEKLFTCVKLIFMEGVKAKQTDALHLETY
At2g44950         LQVTERDDYNIKL--------------------------FLEGITSRQMQDTLLIDKY
AAL91211          LQVTERDDYNIKL--------------------------FLEGITSRQMQDTLLIDKY
scaff_40.53       QQVTERDDYNIK---------------------------GVRARQLRDSLLMDKQ
CAO70576          QQITERDDYNIKL--------------------------VLEGVRSRQLQDSLLMEKQ
TA45131_4081      QQITERDDYNIKL--------------------------VLEGVRARQQRDCLAWESQ
AC144591          HQITERDDYNIKL--------------------------VLEGVRARQKQDSFIMEMR
ABE92765          HQITERDDYNIKL--------------------------VLEGVRARQKQDSFIMEMR
BAB14005          QQLREKDDANFKL--------------------------MSERIKSNQIHKLLKEEKE
AAH18647          QQLREKDDANFKL--------------------------MSERIKANQIHKLLREEKD
AAF50744          QQLREKDDANFKL--------------------------MSERIKANQLHKLLREEKT
AAK21443          IEKREQEDRNLKM--------------------------MNDRMIQNQTFNRLREKLS
CAA98640          SEIINHESVISKLT---------------------VEKTKADQKYFAAMRSKDSILIEIK
NP_587845         QELITKFSV-----------------------------EKEKAEQKYFLTMKSTD
                     :   :  .                                        :        .
```

FIG. 2 (continued)

```
XP_001754625    VLDADMQHANSDADLHKQRITYLEEQASTFIAHLEKATDENRQQSSAMESAKRKAVEAEK
XP_001777122    VLNARMQHVIARADLHKQHVARIEDQARAFIHEHGKAIDESRHQSSAMESAKRKAVEMEK
EDQ74097        ILASRVQHANATAEHHKQRVSRLEDQARSYIEQIGKVMDNGRQHTLSMETLRRKTAETEK
CAO22034        ALAKQLQQVNNALESLKMRIAQSEEQMKVCLAEALKYTQEDRHLAVSLETAKWELADAEK
AAG51572        VMEKQLHQVNASVENFKARIAHNEEQMKGCFSEAYKLIQEDRHLVISLETTKWEVADADK
ABB47997        MLQKQLQHVNSSLESSKLKITSGEEQMKTYVAQAMKSSSENRHLAISLERTMLEVSDAEK
LOC_Os04g46450  SLRRNLQQESSLMDLYNQKIVSLEDQLKMWSDRVGKLQEDGWQQSVSLSNYQRKLVDVHR
CAD41603        SLRRNLQQESSLMDLYNQKIVSLEDQLKMWSDRVGKLQEDGWQQSVSLSNYQRKLVDVHR
At2g44950       IMDKDIQQGSAYASFLSKKSSRIEDQLRFCTDQFQKLAEDKYQKSVSLENLQKKRADIGN
AAL91211        IMDKDIQQGSAYASFLSKKSSRIEDQLRFCTDQFQKLAEDKYQKSVSLENLQKKRADIGN
scaff_40.53     TMEKEIQQANISVDFFDVKAARIEDQLKNCSDQVHKLAEDKFQRSVMLENTQKKLLDLRR
CAO70576        TMERGFQRATTSLGFFDMKAGRIEDQLKMCSDQVQKLAEDRLQSLGTLANFQKRLLDVTR
TA45131_4081    ITERAVEDANTMVSSYEMKAAKIDDQLRGCSDLIQKLAEDRGQNSLALENTQKRFLDVRK
AC144591        LMEQEMQQSNVSLNLYNTKAAKIEDMRFCSDQIQKLVDNKLQSSVDLENTQRRLSDIRP
ABE92765        LMEQEMQQSNVSLNLYNTKAAKIEDMRFCSDQIQKLVDNKLQSSVDLENTQRRLSDIRP
BAB14005        ELADQVLTLKTQVDAQLQVVRKLEEKEHLLQSNIGTGEKELGLRTQALEMNKRKAMEAAQ
AAH18647        ELGEQVLGLKSQVDAQLLTVQKLEEKERALQGSLGGVEKELTLRSQALELNKRKAVEAAQ
AAF50744        VLEDQMATATTQIEAMHIVLRKLEEKERSLQATVASIEKELMLRQQAMEMHKRKAIESAQ
AAK21443        CLESKAQTDAQIAKMHEFEKKANEELVTKLSESVQFKSAELTRLTNLMEQHRKNIQEVGM
CAA98640        TLSKSLSKSNELILQLKDSDRLLQQKIGNLHKQLDLSQNNERRLIDSSKTETLKIIDLNN
NP_587845       SLHAEVKLLRQKYQKTNEIISKMLNSQDTAVHRIIEFEDQLARLSSVRNNSIKQSTTFQV
                                      :              :                 .

XP_001754625    QLSSVKLALDAAHKLLEERGQNFLNVNLQLEKE--RFNKRRAREELEVLNMKITRLQ---
XP_001777122    ELASAKSALAAADKLLEERGQRLLNVNLQLGKESFRFEKRRAQEDLKIVNMKTARLH---
EDQ74097        ELLSVKTSLEATNKRIEDRGHKLAEAQQQLDKE--RFEKRRVQDELEALNNKLSRLR---
CAO22034        ELKWLKSALASSEKEYEQIQRKKEEVQMELDNE--RSERLKLEEELKELNREIAEMS---
AAG51572        EFRWLKSAVSSSEKEYEQISRRTDDIKLELDDE--R-EKKKLEEELMELNKELEELG---
ABB47997        ELKWLRSATGSAEKEYEINQKKIAELKMELERE--RNERIKLEEEYEEVKNEVSELT---
LOC_Os04g46450  DAQKLMQSLDGIQANVGSSRLEVADLLIELEKE--RFSKKRIEDDLEVMSRKASSLR---
CAD41603        DAQKLMQSLDGIQANVGSSRLEVADLLIELEKE--RFSKKRIEDDLEVMSRKASSLR---
At2g44950       GLEQARSRLEESHSKVEQSRLDYGALELELEIE--RFNRRRIEEEMEIAKKKVSRLR---
AAL91211        GLEQARSRLEESHSKVEQSRLDYGALELELEIE--RFNRRRIEEEMEIAKKKVSRLR---
scaff_40.53     SSNQARESLEDSQSRVERSRAALLEVQIDLEKE--GFDKRRMEEELEVARREFSRLQ---
CAO70576        LSQQARESLEESQSKVDKSRVSLGELQIELEKE--RFEKKRTEEELEVVRRKASRLR---
TA45131_4081    SSQQLRETLEEWQSKIDEVRVDLAQLQIELEKE--RFERKRABEDVEALRRKTSRLR---
AC144591        SSQQVRNTVVEVQSKITSSRVTHMELLVDLEKE--RFAKKRVEKDLEVARRNFSHLK---
ABE92765        SSQQVRNTVVEVQSKITSSRVTHMELLVDLEKE--RFAKKRVEKDLEVARRNFSHLK---
BAB14005        LADDLKAQLELAQKKLHDFQDEIVENSVTKEKD--MFNFKRAQEDISRLRRKLETTKK--
AAH18647        LAEDLKVQLEHVQTRLREIQPCLAESRAAREKE--SFNLKRAQEDISRLRRKLEKQRK--
AAF50744        SAADLKLHLEKYHAQMKEAQQVVAEKTSSLEAE--AYKTKRLQEELAQFKRKAERMKK--
AAK21443        SRDENQIKADRCEGQMKQIQELYAAKAREIEDF--KFKRQRAEEELETLRIKYERVKR--
CAA98640        TSTKLKRSLEKLQEESNKSIADMTHLETKLNDT--EIELKHFKQKASHLESKCEKLHDTL
NP_587845       KKSSQKSTIQNLEEKVSYLQQFMDKNNATLTDL--EFQCSDLSSSIDILSKQDEEHEK--
                                                                      ..    :
```

```
XP_001754625      ---TPHDSGPTVDRLREEIRNYEAILKCSVC-QDRSKEVVITKCYHLFCSPCIQRNLELR
XP_001777122      ---SLHDVGSTAERLQEQVNDYRAILQCNVC-HDRNFQAIITKCYHLFCMPCIQRNLESK
EDQ74097          ---SHHERGPAIERLQEDIKEYKAILKCSVC-HDRAKDVVITKCFHLFCGPCIQRNLEIR
CAO22034          ---SESGE-AAIQKLQDEIKDGKAILKCGVC-FDRPKEVVIVKCYHLFCNPCIQRNLEIR
AAG51572          ---SESVE-AAIVRLQEEVKNCKNILKCGVC-FDRPKEVVIVKCYHLFCQQCIQRSLEIR
ABB47997          ---SETEE-TTIQKLQDEIKECKAILKCGVC-FDRPKEVVITKCFHLFCSPCIQRNLEIR
LOC_Os04g46450    ---AKARESAVLEKLRHEVKEYRGILKCGIC-HDRQKEVVITKCYHLFCNQCIQKSLGNR
CAD41603          ---AKARESAVLEKLRHEVKEYRGILKCGIC-HDRQKEVVITKCYHLFCNQCIQKSLGNR
At2g44950         ---SLIEGSSAIQKLRQELSEFKEILKCKAC-NDRPKEVVITKCYHLFCNPCVQKLTGTR
AAL91211          ---SLIEGSSAIQKLRQELSEFKEILKCKAC-NDRPKEVVITKCYHLFCNPCVQKLTGTR
scaff_40.53       ---EHTEGSSIVEKLQQELREYREIVKCSIC-LDRPKEAVITKCYHLFCNPCIQRIVESR
CAO70576          ---AQTECSSIVDKLRLREYRDILKCGIC-HERPKEVVITKCYHLFCNPCVQRIIEAR
TA45131_4081      ---SHIERSSVIEKLQQKLREYKEILNCSIC-FDRRXEVVLAKWYHLFCNPCIQKIVETR
AC144591          ---AQDEDSSETDKLQQELGEYRDIVKCSIC-RDRTKEVVITKCYHLFCNSCIQKIAGSR
ABE92765          ---AQDEDSSETDKLQQELGEYRDIVKCSIC-RDRTKEVVITKCYHLFCNSCIQKIAGSR
BAB14005          ---PDN-VPKCDEILMEEIKDYKARLTCPCC-NMRKKDAVLTKCFHVFCFECVKTRYDTR
AAH18647          ---VEV-YADADEILQEEIKEYKARLTCPCC-NTRKKDAVLTKCFHVFCFECVRGRYEAR
AAF50744          ---MEMSGTTIDEVMIEEIREYKETLTCPSC-KVRKDAVLSKCFHVFCYDCLRTRYETR
AAK21443          --NESVPAQSGDQVLEEANRQMKETLTCPSC-KTRPKDCIMLKCYHLFCETCIKTMYDTR
CAA98640          FRGNNKNKGSSDEALVEELANFRTLVYCSLC-SKNWKNMAIKTCGHVFCENCCKERLAAR
NP_587845         --EKRKLKDTGVSTSAEELKTFRAMCKCSVCNFERWKDRIISLCGHGFCYQCIQKRIETR
                                 .    .   *  *  .  :  :   *  **  * :        :

XP_001754625      HRKCPGCGIPFGQNDVRVVYI-
XP_001777122      HRKCPGCGIPFGQNDVRSVYI-
EDQ74097          HRKCPACGIAFGQSDVRTVSI-
CAO22034          HRKCPACGTAFGQNDVRFVKI-
AAG51572          HRKCPGCGTAFGQNDVRLVKM-
ABB47997          HRKCPGCGTPFGQSDVREVKI-
LOC_Os04g46450    QRRCPSCSLSFGANDVKPIYI-
CAD41603          QRRCPSCSLSFGANDVKPIYI-
At2g44950         QKKCPTCSASFGPNDIKPIYI-
AAL91211          QKKCPTCSASFGPNDIKPIYI-
scaff_40.53       HRKCPVCSMSFGHNDVKPVYI-
CAO70576          NRKCPVCSASFGPNDVKPVYI-
TA45131_4081      HRKCPVXLCSFGANDVKAVYI-
AC144591          QRKCPQCGACFGANDVKPVYL-
ABE92765          QRKCPQCGACFGANDVKPVYL-
BAB14005          QRKCPKCNAAFGANDFHRIYIG
AAH18647          QRKCPKCNAAFGAHDFHRIYIS
AAF50744          QRKCPKCNCAFGANDYHRLYLQ
AAK21443          QRKCPKCNSNFGANDFHRIFI-
CAA98640          MRKCPTCNKAFSSNDLLTVHL-
NP_587845         QRRCPICGRGFGASDVIPIHL-
                   ::**       *.  *   :  :
```

FIG. 2 (continued)

USE OF HUB1 POLYNUCLEOTIDES FOR IMPROVING GROWTH CHARACTERISTICS IN PLANTS

RELATED APPLICATIONS

This application is a national stage application (under 35 U.S.C. §371) of PCT/EP2009/059790, filed Jul. 29, 2009, which claims benefit of European application 08161540.3, filed Jul. 31, 2008; European Application 08161514.8, filed Jul. 31, 2008; U.S. Provisional Application 61/085,046, filed Jul. 31, 2008 and U.S. Provisional Application 61/085,431, filed Aug. 1, 2008.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Revised_Sequence_Listing_13987_00138_US. The size of the text file is 3,366 KB, and the text file was created on Mar. 10, 2011.

The present invention relates generally to the field of molecular biology and concerns a method for modifying various plant growth characteristics by modulating expression in a plant of a nucleic acid encoding a HUB1 (Histone Monoubiquitination 1) or encoding another protein useful in the methods of the present invention. The present invention also concerns plants having modulated expression of a nucleic acid encoding a HUB1 or of a nucleic acid encoding another protein useful in the methods of the present invention, which plants have modified growth characteristics relative to corresponding wild type plants or other control plants. The invention also provides hitherto unknown HUB1-encoding nucleic acids, and constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

A further interesting trait is the flowering time of a plant. The life span of a plant can be divided in phases such as germination, vegetative growth, reproductive growth and senescence. The flowering time is the time elapsed between sowing and start of reproductive growth. It is a crucial moment in the life of a plant that determines the transition from vegetative to reproductive growth, which in some plants coincides with the start of senescence. In many plants, this is the point in time at which the shoot apical meristem stops making leaves and starts making flowers which has a great impact on morphogenesis affecting, for example, the number of organs formed and the overall size and shape of the plant. The flowering time also impacts other yield-related traits in plants. Typically an early flowering variety shows less branching or tillering and therefore is less bushy. Such traits may be advantageous to the farmer to, for example, simplify crop management. On the other hand, delayed flowering may result in plants with more vegetative organs, for example more leaves which is a desirable trait in many crops, particularly in crops where the vegetative organs are harvested, such as lettuce. The relative duration of vegetative and reproductive phase of a plant directly affects its seed yield. In some plants, control of flowering time is a mechanism used to avoid negative impact of stresses such as drought. Flowering time may also affect quality traits of crops, for example herbage quality in forage crops, where delay in flowering may result in higher digestibility. The flowering time affects the length of the cultivation season. Modification of flowering time of a crop may result in the possibility to extend the geographic area of cultivation and therefore increase the cultivated acreage. It may also result in plants being more amenable to agriculture in a given environment, for example early flowering may allow late planting in areas where crop establishment may be negatively affected by low temperatures or may allow early harvest to avoid biotic and abiotic pressure at the end of the season, resulting therefore in an increase in the yield of the crop. Therefore, the ability to control flowering time is an important factor with many industrial applications in the field of agriculture.

For crop plants it is also important to respond adequately to the daily rhythms they are exposed to. Anticipation to regular changes in the environment gives plants a growth advantage by shortening the delay between the environmental change and the physiological response thereto. For example, activation of the photosynthesis pathways before daybreak allows optimal use of the light period, or timely activation of drought stress responses protects plants from water shortage during warm summer afternoons.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle, circadian rhythm or various signalling pathways involved in plant growth or in defense mechanisms.

Circadian rhythms control many aspects of plant metabolism, physiology and development. Plants make use of environmental signals such as the daily light-dark cycle or regular temperature variations to maintain a biological time-keeping mechanism. This mechanism, known as the circadian clock, is commonly represented as a so-called oscillator that consists of a set of proteins which interact in a complex pattern of positive and negative transcriptional feedback loops, for a review see McClung (Plant Cell 18, 792-803, 2006) and Gardner et al (Biochemical Journal 397, 15-24, 2006). The oscillator is calibrated by external signals (such as light, perceived by phytochromes and cryptochromes) which are transmitted via the "input pathways" to the oscillator. The oscillator on its turn controls a number of pathways (the "output pathways") which regulate physiological processes that are influenced by the daily environmental changes. An overview is given in Barak et al. (Trends in Plant Science 5, 517-522, 2000) and include for example induction of flowering, opening of petals, opening or closure of stomata, growth of the hypocotyl, movement of cotyledons and leaves, movement of chloraplasts, expression of genes associated with photosynthesis and related biochemical and physiological processes, cytoplasmic calcium concentrations, and the phosphorylation status of proteins like phosphoenol pyruvate carboxylase.

It has now been found that various growth characteristics may be altered in plants by modulating expression in a plant of a nucleic acid encoding a HUB1 (Histone Monoubiquitination 1) in a plant.

BACKGROUND

Ubiquitination plays a central role in regulating protein turnover. Ubiquitin is a highly conserved 76-amino acid protein and one of the most abundant proteins in cells. Ubiquitin proteins are found linked to other proteins as post-translational modification. Polyubiquitination, attachment of more than 4 ubiquitins has been shown to direct proteins for degradation. Ubiquitin conjugation requires sequential action of three enzymes or protein complexes, namely ubiquitin-activating enzyme (E1), ubiquitin-conjugating enzyme (E2), and ubiquitin-protein ligase (E3). Ubiquitin is initially attached to E1 enzyme in an ATP dependent reaction. After ubiquitin activation, it is transferred to the E2 enzyme via thiolester linkage. Finally, the E3 ligase enzyme brings together the substrate and the E2 with attached ubiquitin. Once a polyubiquitin chain is assembled on a substrate, the substrate is captured and degraded by 26S proteasomes. The step of substrate recognition is mediated by E3 ligases, which typically contain a RING domain as a 'docking site' for E2s. The E3 ligase proteins appear in two forms: as single chain E3s that bind directly E2 and their substrate, and as multisubunit complexes in which a RING finger protein is an essential component. The classification of E3 ligases is based on the presence of domains like E6-AP C-terminus, U-box or the Really Interesting Gene (RING) domain. The RING domain is a particular type of Zinc-finger domain that binds two zinc atoms and that is involved in protein-protein interactions. Ubiquitin dependent protein degradation has been acknowledged as an important regulatory means of cell cycle, DNA repair, transcription, protein quality control and immune response.

The hub1 (histone monoubiquitination 1) mutant, also known as hub1-1, ang4-1 or rdo4, belongs to the angusta class of recessive mutants characterised by a reduced leaf size and narrow lamina (Berná et al., Genetics 152, 729-742, 1999), and reduced seed dormancy (Peeters et al., Physiol. Plant. 115, 604-612, 2002; Liu et al., Plant Cell 19, 433-444, 2007). Germination tests (wherein the percentage of germinated seeds was scored after 7 days) showed that this percentage was higher compared to the wild type seeds. However, seedling growth was dependent on the presence of sucrose in the medium (Liu et al., 2007). The mutant plants are small compared to wild type and have narrow leaves, and also root growth is negatively affected (Fleury et al., Plant Cell 19, 417-432, 2007). Overexpression of the HUB1 gene under control of the strong CaMV35S promoter in *Arabidopsis* resulted in plants having increased leaf size (Cnops et al., WO 2006/027310). It is postulated (Liu et al., 2007 and Fleury et al., 2007) that HUB1 is involved chromatin remodelling, but HUB1 may also be involved in protein degradation: BRE1, the yeast homologue of HUB1, is shown to interact with RAD6 and the proteasome (Xiao et al., Mol. Cell. Biol. 25, 637-651, 2005) and HUB1 or HUB2 furthermore aligns with Staring, a protein which is also involved in protein degradation (Chin et al., J. Biol. Chem. 277, 35071-35079, 2002).

SUMMARY

Surprisingly, it has now been found that modulating expression of a nucleic acid encoding a HUB1 polypeptide gives plants having modified growth characteristics, in particular modified light regulated phenotypes, increased seed yield, increased stress resistance, increased early vigour relative to control plants.

According one embodiment, there is provided a method for modifying growth characteristics of a plant relative to control plants, comprising modulating expression of a nucleic acid encoding a HUB1 polypeptide in a plant. The modified growth characteristics comprise increased seed yield, increased stress resistance, increased early vigour and modified light regulated phenotypes relative to control plants, but do not comprise increased vegetative biomass.

The invention also encompasses the construction of a dominant positive mutant of HUB1; therefore, in another embodiment, there is provided a dominant positive mutant form of HUB1 and its use for improving growth characteristics of plants.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag·100 epitope, c-myc epitope, FLAG® epitope tag, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5°\,C. + 16.6 \times \log_{10}[Na^+]^a + 0.41 \times \%[G/C^b] - 500 \times [L^c]^{-1} - 0.61 \times \% \text{ formamide}$$

2) DNA-RNA or RNA-RNA hybrids:

$$Tm = 79.8 + 18.5(\log_{10}[Na^+]^a) + 0.58(\%G/C^b) + 11.8(\%G/C^b)^2 - 820/L^c$$

3) oligo-DNA or oligo-RNA$^d$ hybrids:

For <20 nucleotides: $T_m = 2(I_n)$

For 20-35 nucleotides: $T_m = 22 + 1.46(I_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $I_n$=effective length of primer=2×(no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic acid sequences Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
| --- | --- |
| RCc3 | Plant Mol Biol. 1995 January; 27(2): 237-48 |
| *Arabidopsis* PHT1 | Kovama et al., 2005; Mudge et al. (2002, Plant J. 31: 341) |
| *Medicago* phosphate transporter | Xiao et al., 2006 |
| *Arabidopsis* Pyk10 | Nitz et al. (2001) Plant Sci 161 (2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| *B. napus* G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 *Brassica napus* | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (*Daucus carota*) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (*Arabidopsis*) | Diener et al. (2001, Plant Cell 13: 1625) |
| NRT2;1Np (*N. plumbaginifolia*) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm-, aleurone-, and/or embryo-specific. Examples of seed-specific promoters are shown in Table 2c below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2d below.

TABLE 2d

Examples of green tissue-specific promoters

| Gene | Expression | Reference |
|---|---|---|
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2e below.

TABLE 2e

Examples of meristem-specific promoters

| Gene source | Expression pattern | Reference |
| --- | --- | --- |
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/ nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol. Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J. 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Tripsacum dactyloides*, *Triticosecale rimpaui*, *Triticum* spp. (e.g. *Triticum aestivum*, *Triticum durum*, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

DETAILED DESCRIPTION OF THE INVENTION

Surprisingly, it has now been found that modulating expression in a plant of a nucleic acid encoding a HUB1 polypeptide gives plants having modified growth characteristics relative to control plants. According to a first embodiment, the present invention provides a method for altering growth characteristics in plants relative to control plants and in particular for modifying light regulated phenotypes, comprising modulating expression in a plant of a nucleic acid encoding a HUB1 polypeptide or a part thereof. In one particular embodiment, wherein HUB1 is misexpressed, the modified light regulated phenotypes encompass a modification of the circadian clock of the plant, a modification of the circadian clock downstream pathways, such as modified photosynthetic capacity (exemplified by reduced photosynthetic pigments, defects in plastid structure), a modified expression pattern of developmental genes, and/or modified plant development, exemplified by altered flowering time or a modified plant architecture (including leaf morphology, flower morphology or hypocotyl length). According to another embodiment, the present invention provides a method for improving growth characteristics in plants, in particular increased early vigour, increased germination vigour and/or increased yield (biomass and/or seed yield) relative to control plants, comprising modulating expression in a plant of a nucleic acid encoding a HUB1 polypeptide, and/or comprising modulating expression of genes encoding target proteins of HUB1 and/or proteins interacting with HUB1.

A preferred method for modulating (increasing or decreasing) expression of a nucleic acid encoding a HUB1 polypeptide is by introducing and expressing in a plant a nucleic acid encoding a HUB1 polypeptide or a part thereof. The tem "misexpression" of a gene as used in the present invention comprises downregulated expression of the gene as well as reduced activity of the protein encoded by the gene by for example reducing the concentration of the protein (reduced synthesis or increased degradation) or by introducing mutations in the protein for decreasing the intrinsic activity or the capability to interact with ligands, cofactors or other interactors. Methods for downregulating expression are provided in the definitions section.

Any reference hereinafter to a "protein useful in the methods of the invention" is taken to mean a HUB1 polypeptide as defined herein. Any reference hereinafter to a "nucleic acid useful in the methods of the invention" is taken to mean a nucleic acid capable of encoding such a HUB1 polypeptide or a part thereof. The nucleic acid to be introduced into a plant (and therefore useful in performing the methods of the invention) is any nucleic acid encoding the type of protein which will now be described, hereafter also named "HUB1 nucleic acid" or "HUB1 gene".

A "HUB1 polypeptide" as defined herein refers to a ubiquitin-protein ligase (E3 ligase) comprising a RING domain. E3 ligases mediate ubiquitination of substrate proteins. Preferably, the HUB1 polypeptide belongs to the RING HCa class of E3 ligase proteins (Stone et al., Plant Physiol. 137, 13-30, 2005). The RING domain is a special type of Zn-finger domains and is involved in protein-protein interactions. Preferably, the RING domain is a C3HC4 type RING domain and corresponds to Pfam entry PF00097. C3HC4 domains have the following consensus sequence (Lorick et al., Proc. Natl. Acad. Sci. USA 96, 11364-11369, 1999): C—X2-C—X(9-39)-C—X(1-3)-H—X(2-3)-C—X2-C—X(4-48)-C—X2-C (the cofactor coordination residues are indicated in bold underlined, see also the multiple alignment in FIG. 2). Preferably, the consensus sequence is C—X2-C—X11-C—X—H—X2-C—X2-C—X11-C—X2-C. The C3HC4 domains are reported to bind 2 metal cofactors, in particular zinc; the first cofactor is putatively bound by the first four coordination residues (numbers 1 to 4 in FIG. 1B(i) and the second cofactor is putatively bound by the last four coordination residues (numbers 5 to 8 in FIG. 1B(i)).

The term "HUB1 polypeptide" as used in the present invention also encompasses mutant forms with reduced auto-polyubiquitination but with normal, reduced or completely eliminated substrate ubiquitination activity (dominant positive forms of a HUB1 polypeptide). In one such dominant positive form, the Cys residues nr 1 and 2 of the C3HC4 domain (FIG. 1B(i)) were mutated into Ser residues (FIG. 1B(ii) and (iii)).

Alternatively, the homologue of a HUB1 protein has in increasing order of preference at least 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2, provided that the homologous protein comprises the conserved motif as outlined above. The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs (such as the RING domain, see Example 3) are considered.

Preferably, the polypeptide sequence which when used in the construction of a phylogenetic tree, such as the one depicted in FIG. 3, clusters with the group of HUB1 polypeptides comprising the amino acid sequence represented by SEQ ID NO: 2 (At2g44950) rather than with any other group of proteins comprising a RING domain.

The terms "domain", "signature" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BEST-FIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol. 147(1); 195-7).

Furthermore, HUB1 polypeptides (at least in their native form) typically mediate monoubiquitination of Histone H2B. Tools and techniques for measuring in vitro ubiquitination are well known in the art, see for example Fleury et al (2007) or Liu et al (2007). Further details are provided in Example 6.

In addition, HUB1 polypeptides, when expressed in rice or *Arabidopsis* according to the methods of the present invention as outlined in the Examples section, give plants having amongst other, modified light regulated phenotypes, increased early vigour, increased germination vigour and/or increased seed yield related traits, including (but not limited to) total number of seeds, number of filled seeds or total seed weight.

The invention also provides dominant positive forms of a HUB1 polypeptide. In one dominant positive form (HUB1pm), the Cys residues nr 1 and 2 of the C3HC4 domain (FIG. 1B(i)) were mutated into Ser residues (FIG. 1B(ii) and (iii)). Surprisingly, the H2B monoubiquitination was not influenced by these point mutations (FIG. 5, HA-Ab) whereas the autopolyubiquitination activity of HUB1 was negatively affected. Also the presence of the substrate reduced the autopolyubiquitination activity, suggesting that in the absence of substrate HUB1 protein may be removed through protein degradation. This reduced autoregulation may lead to stabilization of the protein, thereby creating a dominant positive form of the protein with enhanced activity.

The overexpression of wild type HUB1 has positive influence on plant growth, therefore it is expected that a dominant positive or stabilized form of HUB1 may allow further improvement these growth effects (See Example 16). It is also postulated that other mutations substantially preventing cofactor binding in one of both Zn-binding sites will have a comparable effect on the protein function; these other mutations encompass any type of mutation(s), including insertion mutagenesis to disrupt or increase the open reading frame. The term "HUB1 polypeptide" as used in the present invention thus also encompasses mutant forms with reduced autopolyubiquitination but with normal, reduced or completely eliminated substrate ubiquitination activity.

Therefore, according to a further embodiment of the present invention, there is provided an isolated polypeptide selected from:

(i) a polypeptide sequence encoding a HUB1 protein as defined above, comprising in its RING domain one or more mutations that substantially prevent cofactor binding in the Zn-binding sites and wherein said one or more mutations reduce autopolyubiquitination without affecting substrate ubiquitination;

(ii) a HUB1 polypeptide sequence represented by SEQ ID NO: 28;

(iii) a polypeptide sequence having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: 28, and comprising a RING domain, which RING domain comprises one or more mutations as defined in (i);

(iv) functional fragments of any of the amino acid sequences given in (i), (ii), or (iii) above, provided that the functional fragment comprises a RING domain, which RING domain comprises one or more mutations as defined in (i).

Preferably, the HUB1 polypeptide sequence as defined in (i) above is a HUB1 polypeptide wherein binding of one cofactor is substantially prevented, more preferably binding of the first cofactor is prevented.

According to a further embodiment of the present invention, there is also provided an isolated nucleic acid molecule encoding a HUB1 polypeptide as defined in (i) to (iv) above, or a nucleic acid capable of hybridising under stringent conditions to the complement of an isolated nucleic acid encoding a HUB1 polypeptide as defined in (i) to (iv) above; preferably the isolated nucleic acid is as represented by SEQ ID NO: 49.

In a further embodiment, the invention provides genes having altered expression levels in plants overexpressing a HUB1 polypeptide relative to expression levels in corresponding wild type plants. Furthermore, the present invention provides means to modulate expression of these genes, which in turn allows for modulation of the biological processes that they control. The present invention provides methods to mimic HUB1 polypeptide level and/or activity by manipulating downstream factors involved in HUB1 polypeptide regulated pathways. This strategy allows a fine-tuning of the effects of the HUB1 polypeptide. Whereas overexpression or downregulation of a HUB1 polypeptide can be pleiotropic and/or can have pleiotropic effects, the invention provides methods to alter plant characteristics in a more controlled and targeted way, by using the HUB1 polypeptide target genes as defined by the present invention. Modulation of particular biological processes is now possible and may give rise to plants having altered characteristics, which may have particularly useful applications in agriculture and horticulture, such as improved yield-related traits for plants grown under normal or under stress conditions.

Therefore, according to the present invention, there is provided a method to enhance one or more yield-related traits in plants, comprising modifying in a plant expression of one or more nucleic acids and/or modifying level and/or activity of one or more proteins, which nucleic acids or proteins are essentially similar to any one of the genes listed in Tables G to K, and wherein said one or more yield-related traits are altered relative to corresponding wild type plants. Furthermore, the present invention provides methods for modifying the circadian clock in plants, for modifying the photosynthetic capacity and/or for modifying plant development.

The present invention is illustrated by transforming plants with the nucleic acid sequence represented by SEQ ID NO: 1, encoding the polypeptide sequence of SEQ ID NO: 2 and with plants comprising a mutation in the HUB1 gene (hub1-1, Fleury et al, 2007). However, performance of the invention is not restricted to these sequences; the methods of the invention may advantageously be performed using any HUB1-encoding nucleic acid or HUB1 polypeptide as defined herein, or any dominant positive mutant of HUB1. Alternatively, plants may be subjected to mutagenesis to generate a mutant form of the endogenous HUB1 gene that has the same functional characteristics as the dominant positive mutant or the hub1-1 mutant. Techniques for generating such type of mutations are known in the art (such as TILLING or site-specific recombination (Thomson and Ow, Genesis 44, 465-476, 2006)). Furthermore, any of the genes listed in Table G to K (which include SEQ ID NO: 50 to SEQ ID NO: 243), or the orthologues of such genes, can be used in the methods of the present invention.

Examples of nucleic acids encoding HUB1 polypeptides are given in Table A of Example 1 herein. Such nucleic acids are useful in performing the methods of the invention. The amino acid sequences given in Table A of Example 1 are example sequences of orthologues and paralogues of the HUB1 polypeptide represented by SEQ ID NO: 2, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Examples of proteins involved in the circadian clock, in the output response of the circadian clock and or in development are provided in Table G, H and I. Examples of proteins that interact with HUB1 are listed in Tables J, K and L. All these proteins (including orthologues) are useful in the methods of the present invention, hereafter referred to as "other proteins useful in the methods of the present invention".

Nucleic acid variants may also be useful in practising the methods of the invention. Examples of such variants include nucleic acids encoding homologues and derivatives of any one of the amino acid sequences given in Table A of Example 1 or of other proteins useful in the methods of the present invention, the terms "homologue" and "derivative" being as defined herein. Also useful in the methods of the invention are nucleic acids encoding homologues and derivatives of orthologues or paralogues of any one of the amino acid sequences given in Table A of Example 1 or of other proteins useful in the methods of the present invention. Homologues and derivatives useful in the methods of the present invention have substantially the same biological and functional activity as the unmodified protein from which they are derived.

Further nucleic acid variants useful in practising the methods of the invention include portions of nucleic acids encoding HUB1 polypeptides, nucleic acids hybridising to nucleic acids encoding HUB1 polypeptides, splice variants of nucleic acids encoding HUB1 polypeptides, allelic variants of nucleic acids encoding HUB1 polypeptides and variants of nucleic acids encoding HUB1 polypeptides obtained by gene shuffling. The terms hybridising sequence, splice variant, allelic variant and gene shuffling are as described herein. Also nucleic acid variants of nucleic acids encoding other proteins useful in the methods of the present invention, nucleic acids hybridising to nucleic acids encoding other proteins useful in the methods of the present invention, splice variants of nucleic acids encoding other proteins useful in the methods of the present invention, allelic variants of nucleic acids encoding other proteins useful in the methods of the present invention, and variants of nucleic acids encoding other proteins useful in the methods of the present invention obtained by gene shuffling are useful in practising the methods of the invention.

Nucleic acids encoding HUB1 polypeptides or other proteins useful in the methods of the present invention need not be full-length nucleic acids, since performance of the methods of the invention does not rely on the use of full-length nucleic acid sequences. According to the present invention, there is provided a method for modifying growth characteristics in plants, comprising introducing and expressing in a plant a portion of any one of the nucleic acid sequences given in Table A of Example 1 or in Tables G to K, or a portion of a nucleic acid encoding an orthologue, paralogue or homologue of any of the amino acid sequences given in Table A of Example 1 or in Tables G to K.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode a HUB1 polypeptide as defined herein, and have substantially the same biological activity as the amino acid sequences given in Table A of Example 1 or in Tables G to K. Preferably, the portion is a portion of any one of the nucleic acids given in Table A of Example 1, or is a portion of a nucleic acid encoding an orthologue or paralogue of any one of the amino acid sequences given in Table A of Example 1. Preferably the portion is at least 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000 consecutive nucleotides in length, the consecutive nucleotides being of any one of the nucleic acid sequences given in Table A of Example 1 or in Tables G to K, or of a nucleic acid encoding an orthologue or paralogue of any one of the amino acid sequences given in Table A of Example 1 or in Tables G to K. Most preferably the portion is a portion of the nucleic acid of SEQ ID NO: 1 or of a nucleic encoding a protein given in Tables G to K. Preferably, the portion encodes a fragment of a HUB1 polypeptide sequence which when used in the construction of a phylogenetic tree, such as the one depicted in FIG. 3, clusters with the group of HUB1 polypeptides comprising the amino acid sequence represented by SEQ ID NO: 2 (At2g44950) rather than with any other group of proteins comprising a RING domain.

Another nucleic acid variant useful in the methods of the invention is a nucleic acid capable of hybridising, under reduced stringency conditions, preferably under stringent conditions, with a nucleic acid encoding a HUB1 polypeptide as defined herein or with a nucleic acid encoding a protein as given in any of Tables G to K, or with a portion as defined herein.

According to the present invention, there is provided a method for modifying growth characteristics in plants, comprising introducing and expressing in a plant a nucleic acid capable of hybridizing to any one of the nucleic acids given in Table A of Example 1 or in Tables G to K, or comprising introducing and expressing in a plant a nucleic acid capable of hybridising to a nucleic acid encoding an orthologue, paralogue or homologue of any of the nucleic acid sequences given in Table A of Example 1 or in Tables G to K.

Hybridising sequences useful in the methods of the invention encode a HUB1 polypeptide as defined herein, having substantially the same biological activity as the amino acid sequences given in Table A of Example 1 or in Tables G to K. Preferably, the hybridising sequence is capable of hybridising to the complement of any one of the nucleic acids given in Table A of Example 1 or in Tables G to K, or to a portion of any of these sequences, a portion being as defined above, or the hybridising sequence is capable of hybridising to the complement of a nucleic acid encoding an orthologue or paralogue of any one of the amino acid sequences given in Table A of Example 1 or in Tables G to K. Most preferably, the hybridising sequence is capable of hybridising to the complement of a nucleic acid as represented by SEQ ID NO: 1 or to a portion thereof.

For HUB1, the hybridising sequence preferably encodes a polypeptide with an amino acid sequence which, when full-length and used in the construction of a phylogenetic tree, such as the one depicted in FIG. 3, clusters with the group of HUB1 polypeptides comprising the amino acid sequence represented by SEQ ID NO: 2 (At2g44950) rather than with any other group of proteins comprising a RING domain. Preferably, the hybridising sequence encodes a protein having a C3HC4 type RING domain.

Another nucleic acid variant useful in the methods of the invention is a splice variant encoding a HUB1 polypeptide as defined hereinabove or encoding other proteins useful in the methods of the present invention, a splice variant being as defined herein.

According to the present invention, there is provided a method for modifying growth characteristics in plants, comprising introducing and expressing in a plant a splice variant of any one of the nucleic acid sequences given in Table A of Example 1 or in Tables G to K, or a splice variant of a nucleic acid encoding an orthologue, paralogue or homologue of any of the amino acid sequences given in Table A of Example 1 or in Tables G to K.

Preferred splice variants are splice variants of a nucleic acid represented by SEQ ID NO: 1, or a splice variant of a nucleic acid encoding an orthologue or paralogue of SEQ ID NO: 2. Preferably, the HUB1 amino acid sequence encoded by the splice variant, when used in the construction of a phylogenetic tree, such as the one depicted in FIG. 3, clusters with the group of HUB1 polypeptides comprising the amino acid sequence represented by SEQ ID NO: 2 (At2g44950) rather than with any other group of proteins comprising a RING domain. Preferably, the splice variant encodes a protein having a C3HC4 type RING domain.

Another nucleic acid variant useful in performing the methods of the invention is an allelic variant of a nucleic acid encoding a HUB1 polypeptide as defined hereinabove or encoding other proteins useful in the methods of the present invention, an allelic variant being as defined herein.

According to the present invention, there is provided a method for modifying growth characteristics in plants, comprising introducing and expressing in a plant an allelic variant of any one of the nucleic acids given in Table A of Example 1 or in Tables G to K, or comprising introducing and expressing in a plant an allelic variant of a nucleic acid encoding an orthologue, paralogue or homologue of any of the amino acid sequences given in Table A of Example 1 or in Tables G to K.

The polypeptides encoded by allelic variants useful in the methods of the present invention have substantially the same biological activity as the HUB1 polypeptide of SEQ ID NO: 2 and any of the amino acids depicted in Table A of Example 1 or in Tables G to K. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2 or of a protein given in Tables G to K. Preferably, the HUB1 amino acid sequence encoded by the allelic variant, when used in the construction of a phylogenetic tree, such as the one depicted in FIG. 3, clusters with the group of HUB1 polypeptides comprising the amino acid sequence represented by SEQ ID NO: 2 (At2g44950) rather than with any other group of proteins comprising a RING domain. Preferably, the allelic variant encodes a protein having a C3HC4 type RING domain.

Gene shuffling or directed evolution may also be used to generate variants of nucleic acids encoding HUB1 polypeptides as defined above or encoding other proteins useful in the methods of the present invention; the term "gene shuffling" being as defined herein.

According to the present invention, there is provided a method for modifying growth characteristics in plants, comprising introducing and expressing in a plant a variant of any one of the nucleic acid sequences given in Table A of Example 1 or in Tables G to K, or comprising introducing and expressing in a plant a variant of a nucleic acid encoding an orthologue, paralogue or homologue of any of the amino acid sequences given in Table A of Example 1 or in Tables G to K, which variant nucleic acid is obtained by gene shuffling.

Preferably, the HUB1 amino acid sequence encoded by the variant nucleic acid obtained by gene shuffling, when used in the construction of a phylogenetic tree such as the one depicted in FIG. 3, clusters with the group of HUB1 polypeptides comprising the amino acid sequence represented by SEQ ID NO: 2 (At2g44950) rather than with any other group of proteins comprising a RING domain.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding HUB1 polypeptides or other proteins useful in the methods of the present invention may be derived from any natural or artificial source. The nucleic acid may be modified from its native form in composition and/or genomic environment through deliberate human manipulation. Preferably the HUB1 polypeptide-encoding nucleic acid or nucleic acids encoding other proteins useful in the methods of the present invention are from a plant, further preferably from a dicotyledonous or a monocotyledonous plant. The HUB1 polypeptide-encoding nucleic acid from a dicotyledonous plant is preferably from the family Brassicaceae, more preferably from *Arabidopsis thaliana*.

Performance of the methods of the invention gives plants having modified growth characteristics. In particular performance of the methods of the invention gives plants having modified light regulated phenotypes, increased germination vigour, increased early vigour, increased stress resistance, altered fruit shape and/or increased seed yield relative to control plants. The term "seed yield" is described in more detail in the "definitions" section herein. It should be noted that the terms "modified growth characteristics" or "yield" as used in the present invention do not encompass vegetative biomass (such as roots, leaves, stems) except where a dominant positive mutant of HUB1 is used in the methods of the present invention.

Reference herein to modified growth characteristics also encompasses a modification of light regulated phenotypes, which include, but are not limited to, an alteration of the circadian clock, and a modification of the pathways downstream of the circadian clock (the circadian clock output responses). The modified downstream pathways encompass one or more of a modified photosynthetic capacity, altered expression of genes involved in plant development and modified plant development. The modification of the circadian clock comprises modified expression of the circadian clock input genes as well as oscillator genes and output genes. The "modified circadian clock output response" or the "modified downstream pathways" as used in the present invention encompasses a modification of the photosynthetic capacity, such as a modification in the concentration of photosynthetic pigments (chlorophyll a and b and total carotenoids) in a plant cell, modified plastid structure, or modified chloroplast structure. The "modified circadian clock output response" or the "modified downstream pathways" as used in the present invention also encompasses altered expression of genes involved in plant development and modifications in plant development such as altered architecture (including reduced hypocotyl length, modified leaf morphology, altered flower morphology) and/or altered flowering time.

Therefore the present invention provides a method for modifying expression of circadian clock input genes, of oscillator genes, of output genes and/or of developmental genes, which method preferably comprises modulating expression of a HUB1 polypeptide. Some of these genes are located close to each other on the chromosome. Therefore, HUB1 can be used as a transcriptional regulator for synchronisation of the transcription of genes that form a cluster. Examples of such clusters are photosynthetic genes, circadian clock genes or developmental genes. The modified expression of the circadian clock input genes, oscillator genes, output genes, developmental genes and/or genes listed in any of Tables G to K (or the orthologues thereof) as the result of modulated HUB1 expression may on its turn result in improved plant growth characteristics such as increased yield or increased stress tolerance. Therefore the present invention provides a method for improving plant growth characteristics which method comprises modulated expression of circadian clock input genes, oscillator genes, output genes and/or developmental genes as the result of modulated HUB1 expression. The present invention also provides a method for improving growth characteristics comprising modulated expression of any of the genes listed in Table G to K, or the orthologue of such a gene. Methods for identifying the orthologue of a gene are described above. The modulated expression may be increased or decreased expression.

The present invention also provides a method for altering plant development, in particular for altering flowering time and/or for modifying plant architecture.

The flowering time is the time elapsed between sowing and start of reproductive growth. Conventional methods for determining the start of flowering include dissecting plants under magnification to determine the presence of either a vegetative or reproductive structure at the meristem; to monitor emergence of the inflorescence, otherwise known as "emergence" or "heading time", or to monitor anthesis. A widely used method for determining the start of flowering in crops in the field involves repeated visual inspection of plots to estimate the number of flowering plants present in a plot. It is conventionally accepted in agronomics that a plot is "flowering" when 50% of plants in a plot exhibit emerged inflorescences. Yet another method is described in WO 2007/093444, this method is based on computer analysis of digital images take from the growing plants.

The term plant architecture encompasses the appearance or morphology of a plant, including any one or more structural features or combination of structural features thereof. Such structural features include the shape, size, number, position, texture, arrangement, and pattern of any cell, tissue or organ or groups of cells, tissues or organs of a plant, including the root, leaf, shoot, stem or tiller, petiole, trichome, flower, inflorescence (for monocotyledonous and dicotyledonous plants), panicles, petal, stigma, style, stamen, pollen, ovule, seed, embryo, endosperm, seed coat, aleurone, fibre, cambium, wood, heartwood, parenchyma, aerenchyma, sieve elements, phloem or vascular tissue, amongst others. Modified architecture therefore includes all aspects of modified growth of the plant.

Preferably, the plants according to the invention exhibit modified architecture, which modified architecture includes one or more of stunted growth, modified leaf morphology, modified hypocotyl morphology, altered flower morphology, relative to control plants. Therefore, according to the present invention, there is provided a method for modifying the architecture of plants, particularly one or more of stunted growth, modified leaf morphology, modified hypocotyl morphology, altered flower morphology, which method comprises modulating expression of a nucleic acid sequence encoding a HUB1 polypeptide as defined herein. The term "stunted growth" as used herein is taken to mean a reduction in plant height without affecting organ size, giving the plant a bushy phenotype, in contrast to dwarfism or miniature growth in which the proportions are maintained but overall plant growth is reduced.

The RING domain in HUB1 proteins is known to be involved in protein-protein interactions. In the present invention, it is shown that HUB1 interacts with various proteins (Example 22). Besides homodimerisation and dimerisation with its paralogue HUB2, HUB1 also interacts with GCN5, a histone acylation enzyme that is involved in stress response, defense, signal transduction, transcription, metabolism, transport. GCN5 is also involved in flower development by affecting expression of WUSCHEL and AGAMOUS. The MYB transcription factor At1g58220, another interactor of HUB1, is involved in responses to plant hormone stimuli (such as abscisic acid, jasmonic acid and salicylic acid). The present invention thus also provides a method for altering responses to one or more of stress responses, defense responses, hormonal signal transduction, and flower development, said method comprising modulation of HUB1 expression.

Reference herein to improved growth characteristics is also taken to mean an increase in biomass (weight) of one or more harvestable parts of a plant, in particular, such harvestable parts are seeds, and performance of the methods of the invention results in plants having increased seed yield relative to the seed yield of control plants. The improved growth characteristics also encompasses increased germination vigour (increased speed of germination), increased early vigour, and increased resistance to stress, in particular abiotic stress. It was furthermore observed that the cell size was increased compared to control plants, particularly in leaves.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid encoding a HUB1 polypeptide as defined herein or encoding another protein useful in the methods of the present invention.

Since the transgenic plants according to the present invention have increased yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination (germination vigour), early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding a HUB1 polypeptide as defined herein or encoding another protein useful in the methods of the present invention.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects.

In particular, the methods of the present invention may be performed under non-stress conditions or under conditions of mild drought to give plants having improved growth characteristics relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions improved growth characteristics relative to control plants grown under comparable conditions. Therefore, according to the present invention, there is provided a method for improving growth characteristics in plants grown under non-stress conditions or under mild drought conditions, which method comprises modulating expression in a plant of a nucleic acid encoding a HUB1 polypeptide or encoding another protein useful in the methods of the present invention. In addition, performance of the methods of the invention also gives plants grown under severe drought conditions improved growth characteristics relative to control plants grown under comparable conditions. Therefore, according to the present invention, there is provided a method for improving growth characteristics in plants grown under severe drought conditions, which method comprises modulating expression in a plant of a nucleic acid encoding a HUB1 polypeptide or encoding another protein useful in the methods of the present invention.

Performance of the methods of the invention gives plants grown under conditions of salt stress, improved growth characteristics relative to control plants grown under comparable conditions. Therefore, according to the present invention, there is provided a method for improving growth characteristics in plants grown under conditions of salt stress, which method comprises modulating expression in a plant of a nucleic acid encoding a HUB1 polypeptide or encoding another protein useful in the methods of the present invention. The term salt stress is not restricted to common salt (NaCl), but may be any one or more of: NaCl, KCl, LiCl, $MgCl_2$, $CaCl_2$, amongst others.

Performance of the methods of the invention gives plants grown under conditions of nutrient deficiency, particularly under conditions of nitrogen deficiency, improved growth characteristics relative to control plants grown under comparable conditions, in other words, the plants according to the invention have an increased efficiency in nutrient uptake. Therefore, according to the present invention, there is provided a method for improving growth characteristics in plants grown under conditions of nutrient deficiency, which method comprises modulating expression in a plant of a nucleic acid encoding a HUB1 polypeptide or encoding another protein useful in the methods of the present invention. Nutrient deficiency may result from a lack of nutrients such as nitrogen, phosphates and other phosphorous-containing compounds, potassium, calcium, magnesium, manganese, iron and boron, amongst others.

The present invention encompasses plants or parts thereof (including seeds) obtainable by the methods according to the present invention. The plants or parts thereof comprise a nucleic acid transgene encoding a HUB1 polypeptide as defined above or encoding another protein useful in the methods of the present invention.

The invention also provides genetic constructs and vectors to facilitate introduction and/or expression in plants of nucleic acids encoding HUB1 polypeptides or encoding another protein useful in the methods of the present invention. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a HUB1 polypeptide as defined above or encoding another protein useful in the methods of the present invention;
(b) one or more control sequences capable of driving expression of the nucleic acid sequence of (a); and optionally
(c) a transcription termination sequence.

Preferably, the nucleic acid encoding a HUB1 polypeptide is as defined above. The proteins useful in the methods of the present invention are as described above and encompass the proteins listed in Table G to K and the orthologues thereof. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter. The rice GOS2 promoter may be useful in monocot plants and a CaMV35S promoter may be useful in dicot plants. In some instances, the constitutive promoter is preferably not a strong constitutive promoter (such as the CaMV35S promoter) and is less strong than the rice GOS2 promoter. However, for obtaining increased early vigour and/or germination vigour, a strong constitutive promoter is useful too. In other instances, an organ specific, a tissue specific or a cell specific promoter is more suitable. See the "Definitions" section herein for definitions of the various promoter types.

It should be clear that the applicability of the present invention is not restricted to the HUB1 polypeptide-encoding nucleic acid represented by SEQ ID NO: 1, nor is the applicability of the invention restricted to expression of a HUB1 polypeptide-encoding nucleic acid when driven by a constitutive promoter, or when driven by a seed-specific promoter.

In one embodiment of this invention, the constitutive promoter is preferably a medium strength promoter that is weaker than the rice GOS2 promoter and the CaMV35S promoter, such as a High Mobility Group Protein (HMGP) promoter, preferably the promoter is a HMGP promoter from rice. Further preferably the constitutive promoter is represented by a nucleic acid sequence substantially similar to SEQ ID NO: 6, most preferably the constitutive promoter is as represented by SEQ ID NO: 6. See Table 2a in the "Definitions" section herein for further examples of constitutive promoters.

According to another embodiment of the invention, the nucleic acid encoding a HUB1 polypeptide is operably linked to a seed-specific promoter. The seed-specific promoter is preferably a WSI18 promoter, more preferably the WSI18 promoter is from rice, further preferably the WSI18 promoter is represented by a nucleic acid sequence substantially similar to SEQ ID NO: 7, most preferably the promoter is as represented by SEQ ID NO: 7. Examples of other seed-specific promoters which may also be used to perform the methods of the invention are shown in Table 2c in the "Definitions" section above.

Optionally, one or more terminator sequences may be used in the construct introduced into a plant.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having modified growth characteristics relative to control plants, comprising introduction and expression in a plant of any nucleic acid encoding a HUB1 polypeptide as defined hereinabove or encoding another protein useful in the methods of the present invention.

More specifically, the present invention provides a method for the production of transgenic plants having modified growth characteristics, particularly increased (seed) yield, which method comprises:
  (i) introducing and expressing in a plant or plant cell a HUB1 polypeptide-encoding nucleic acid or encoding another protein useful in the methods of the present invention; and
  (ii) cultivating the plant cell under conditions promoting plant growth and development.

The nucleic acid of (i) may be any of the nucleic acids capable of encoding a HUB1 polypeptide as defined herein or encoding another protein useful in the methods of the present invention.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a HUB1 polypeptide as defined hereinabove or encoding another protein useful in the methods of the present invention. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, *sorghum*, emmer, spelt, *secale*, einkorn, teff, milo and oats.

The invention also extends to harvestable parts of a plant such as, seeds, fruits, flowers, which harvestable parts comprise a recombinant nucleic acid encoding a HUB1 polypeptide or encoding another protein useful in the methods of the present invention. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding a HUB1 polypeptide or encoding another protein useful in the methods of the present invention is by introducing and expressing in a plant a nucleic acid encoding a HUB1 polypeptide or encoding another protein useful in the methods of the present invention; however the effects of performing the method, i.e. modifying growth characteristics may also be achieved using other well known techniques, including but not limited to T-DNA activation tagging, TILLING, homologous recombination or mutagenesis. A description of these techniques is provided in the definitions section.

The present invention also encompasses use of nucleic acids encoding HUB1 polypeptides or other proteins useful in the methods of the present invention, as described herein and use of these HUB1 polypeptides or other proteins useful in the methods of the present invention in modifying any of the aforementioned growth characteristics in plants.

Nucleic acids encoding HUB1 polypeptide described herein or encoding another protein useful in the methods of the present invention, or the HUB1 polypeptides themselves or another protein useful in the methods of the present invention, may find use in breeding programmes in which a DNA marker is identified which may be genetically linked to a HUB1 polypeptide-encoding gene or linked to a gene encoding another protein useful in the methods of the present invention. The nucleic acids/genes, or the HUB1 polypeptides themselves, or other polypeptides useful in the methods of this invention may be used to define a molecular marker. This DNA or protein marker may then be used in breeding programmes to select plants having modified growth characteristics as defined hereinabove in the methods of the invention.

Allelic variants of a HUB1 polypeptide-encoding nucleic acid/gene or of a nucleic acid/gene encoding another protein useful in the methods of the present invention may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding HUB1 polypeptides or encoding another protein useful in the methods of the present invention may also be used as probes for genetically and physically mapping the genes that they are a part of, and as markers for traits linked to those genes. Such information may be useful in plant breeding in order to develop lines with desired phenotypes. Such use of HUB1 polypeptide-encoding nucleic acids or use of nucleic acids encoding another protein useful in the methods of the present invention requires only a nucleic acid sequence of at least 15 nucleotides in length. The HUB1 polypeptide-encoding nucleic acids or nucleic acids encoding another protein useful in the methods of the present invention may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the HUB1-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the HUB1 polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having modified growth characteristics, as described hereinbefore. These traits may also be combined with other economically advantageous traits, such as further yield-enhancing traits, tolerance to other abiotic and biotic stresses, traits modifying various architectural features and/or biochemical and/or physiological features.

DESCRIPTION OF FIGURES

The present invention will now be described with reference to the following figures in which:

FIG. 1 panel A represents the amino acid sequence of SEQ ID NO: 2, the RING domain is indicated in bold; panel B shows the mutagenesis strategy for generating HUB1pm, (i) Wild type HUB1 RING domain with 8 Zinc binding residues in which X is any amino acid, (ii) Strategy of the mutagenesis on HUB1 gene sequence wherein two Cys residues were selected for mutagenesis (italics & underlined) into Ser. Sequences shown are: DNA (found within SEQ ID NO: 1) and aa (found within SEQ ID NO: 2), (iii) Mutagenised HUB1 RING domain of HUB1pm with two Serine residues.

FIG. 2 represents a multiple alignment of HUB1 proteins. The N-terminal part (600 amino acids) of CAO22034 is not shown in the alignment. Sequences shown are: XP_001754625 (SEQ ID NO: 13); XP_001777122 (SEQ ID NO: 14); EDQ74097 (SEQ ID NO: 12); CAO22034 (SEQ ID NO: 15); AAG51572 (SEQ ID NO: 17); ABB47997 (SEQ ID NO: 20); LOC_Os04g46450 (SEQ ID NO: 10); CAD41603 (SEQ ID NO: 19); At2g44950 (SEQ ID NO: 28); AAL91211 (SEQ ID NO: 16); scaff_40.53 (SEQ ID NO: 8); CAO70576 (SEQ ID NO: 11); TA45131_4081 (SEQ ID NO:

9); ACI44591 (SEQ ID NO: 27); ABE92765 (SEQ ID NO: 18); BAB14005 (SEQ ID NO: 25); AAH18647 (SEQ ID NO: 26); AAF50744 (SEQ ID NO: 24); AAK21443 (SEQ ID NO: 23); CAA98640 (SEQ ID NO: 21); NP_587845 (SEQ ID NO: 22).

Figure 3:
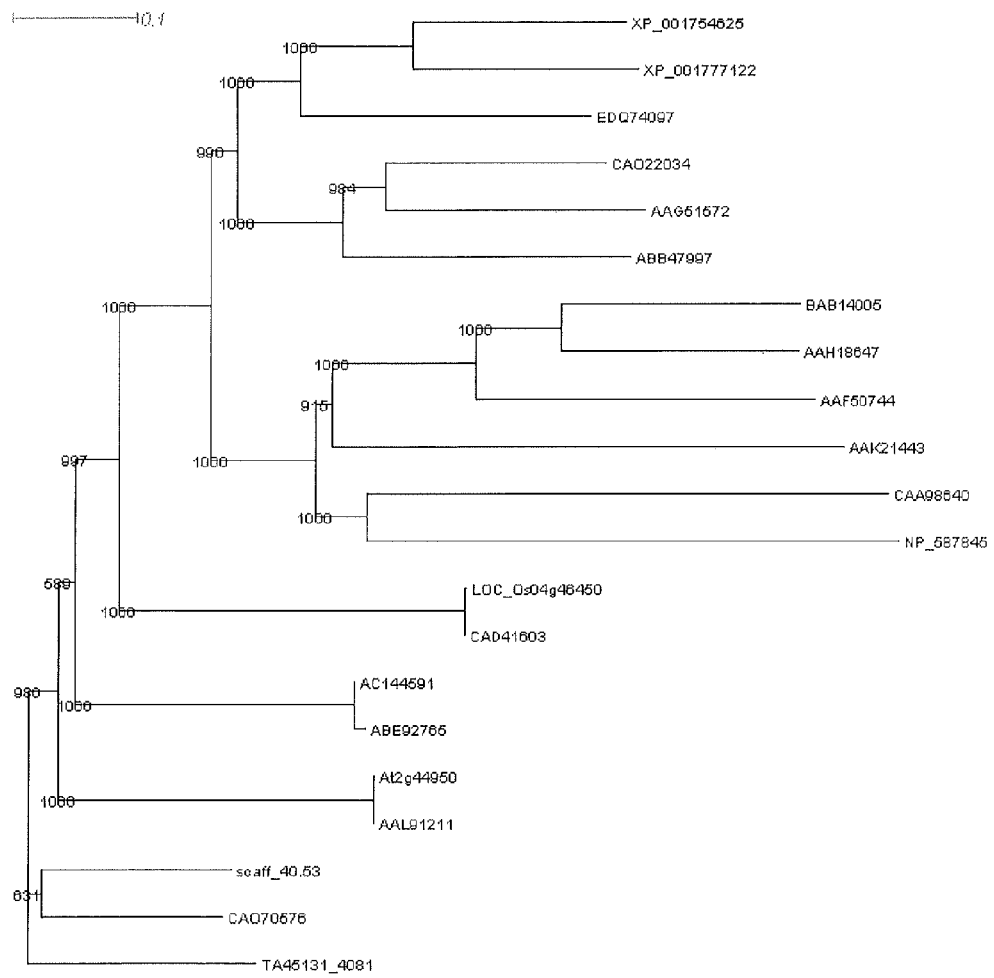

FIG. 3 shows a phylogenetic tree of HUB1 proteins. The tree was constructed as described in Example 2.

Figure 4:
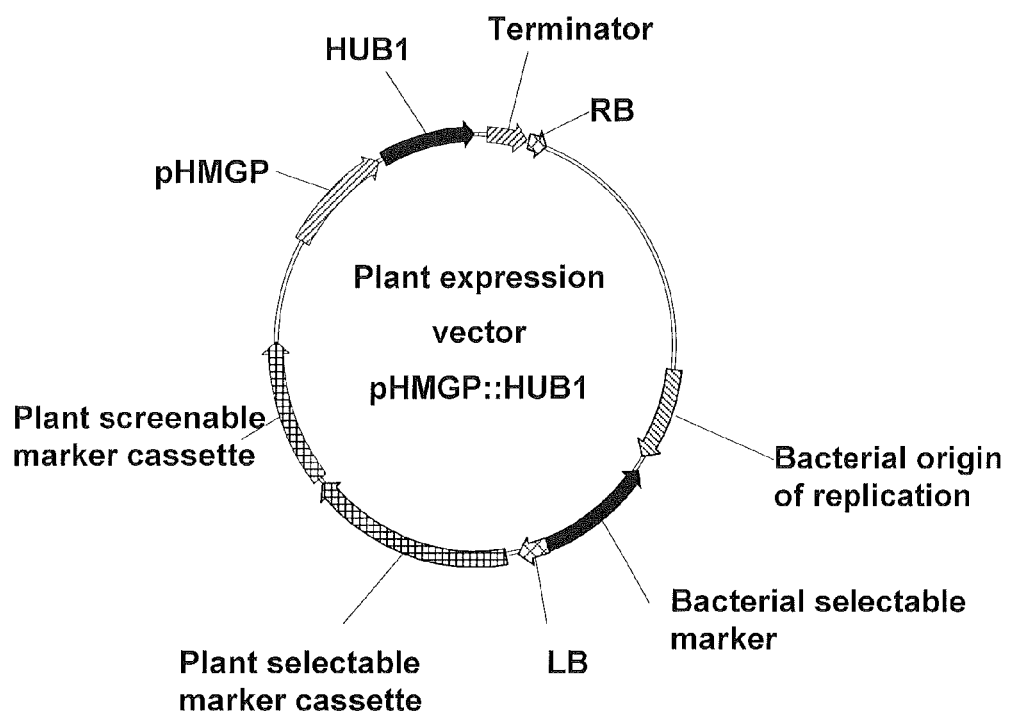

FIG. 4 represents the binary vector for increased expression in *Oryza sativa* of a HUB1-encoding nucleic acid under the control of a rice HMGP promoter (pHMGP)

Figure 5:
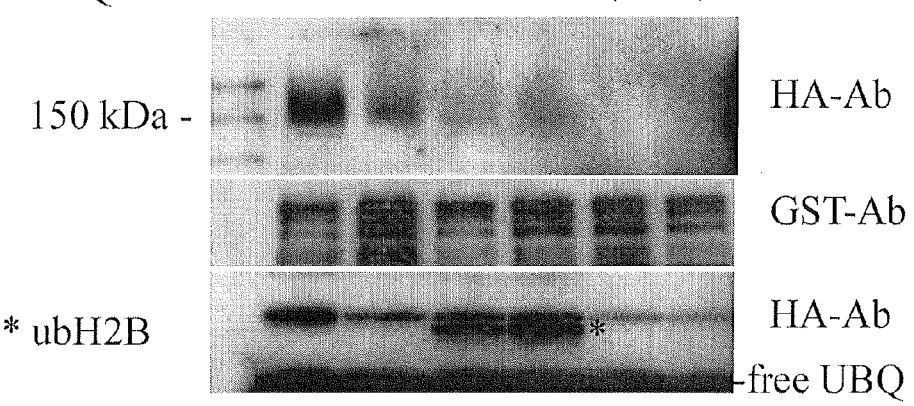

FIG. 5 HUB1 mediated monoubiquitination of histone H2B (HA antibody) and HUB1 autoubiquitination activity (HA antibody).

Figure 6:
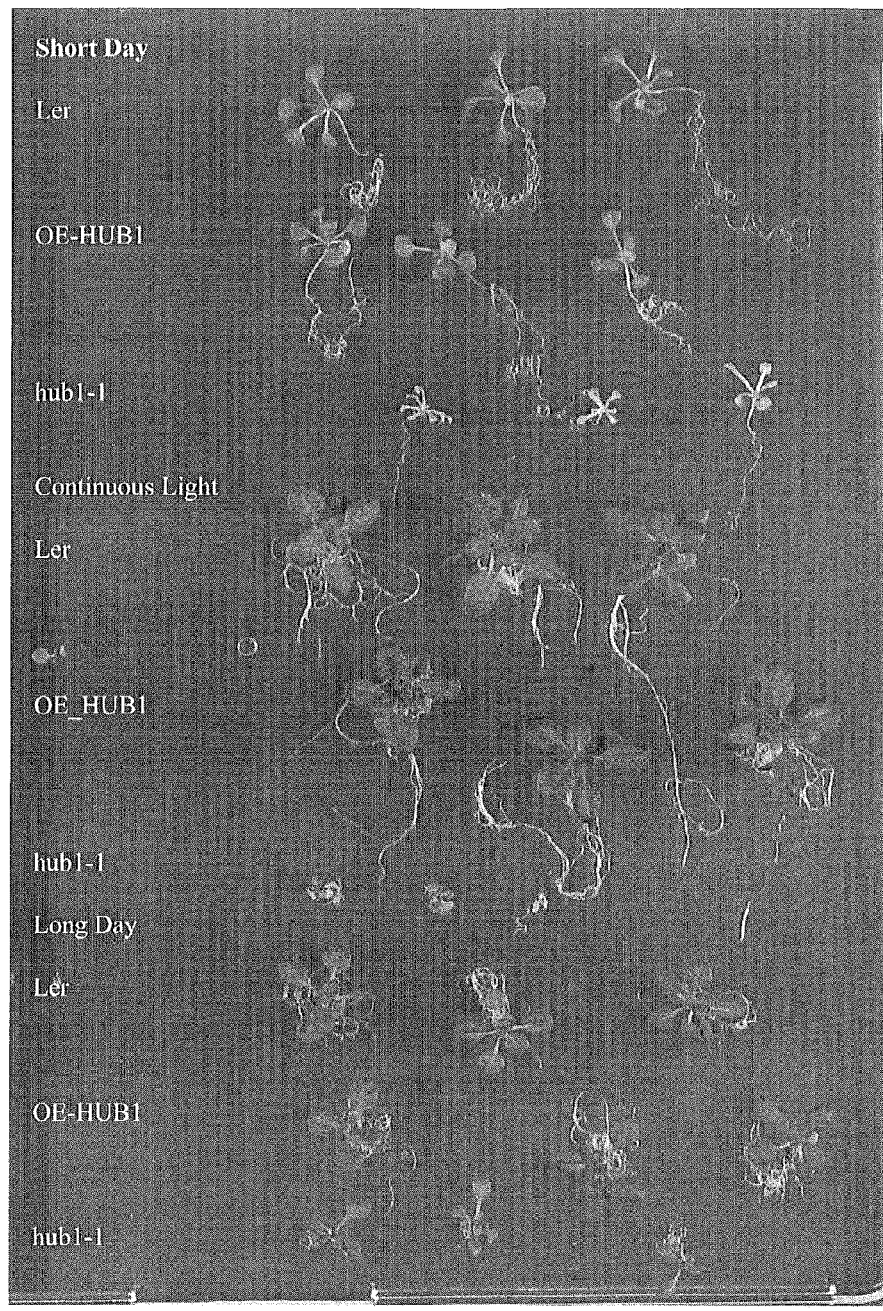

FIG. 6 Rosettes of Ler, hub1-1 and OE-HUB1 lines in short day, long day and continuous light conditions after 21 days of growth.

Figure 7:
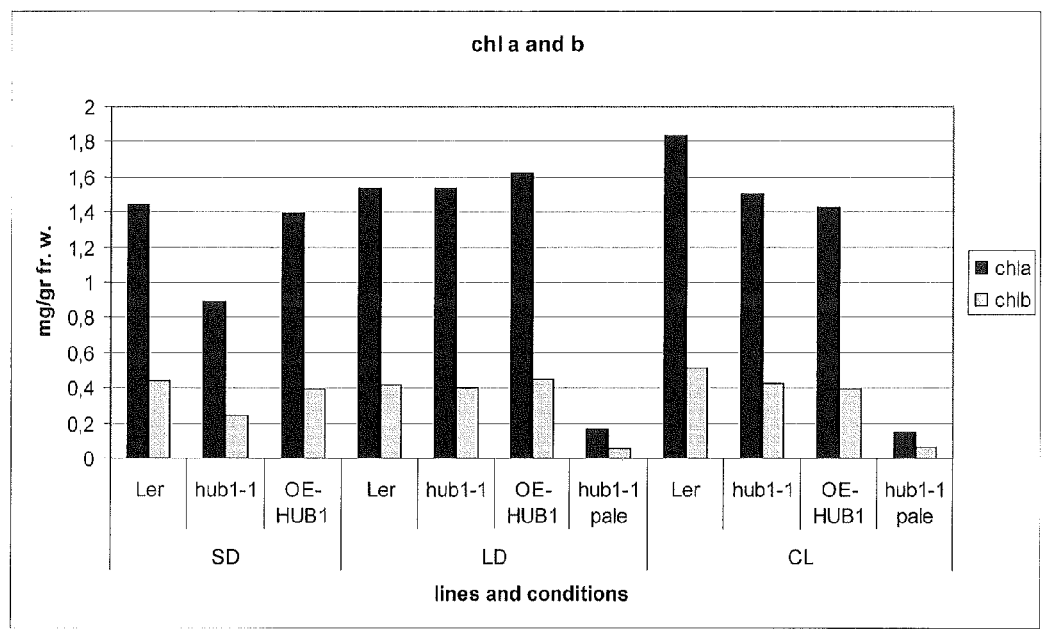

FIG. 7 Measurements of chlorophyll a and b from in vitro grown samples from short day (SD), long day (LD) and continuous light (CL). Both "hub1-1" and "hub1-1 pale" samples were growing on same plates.

Figure 8:
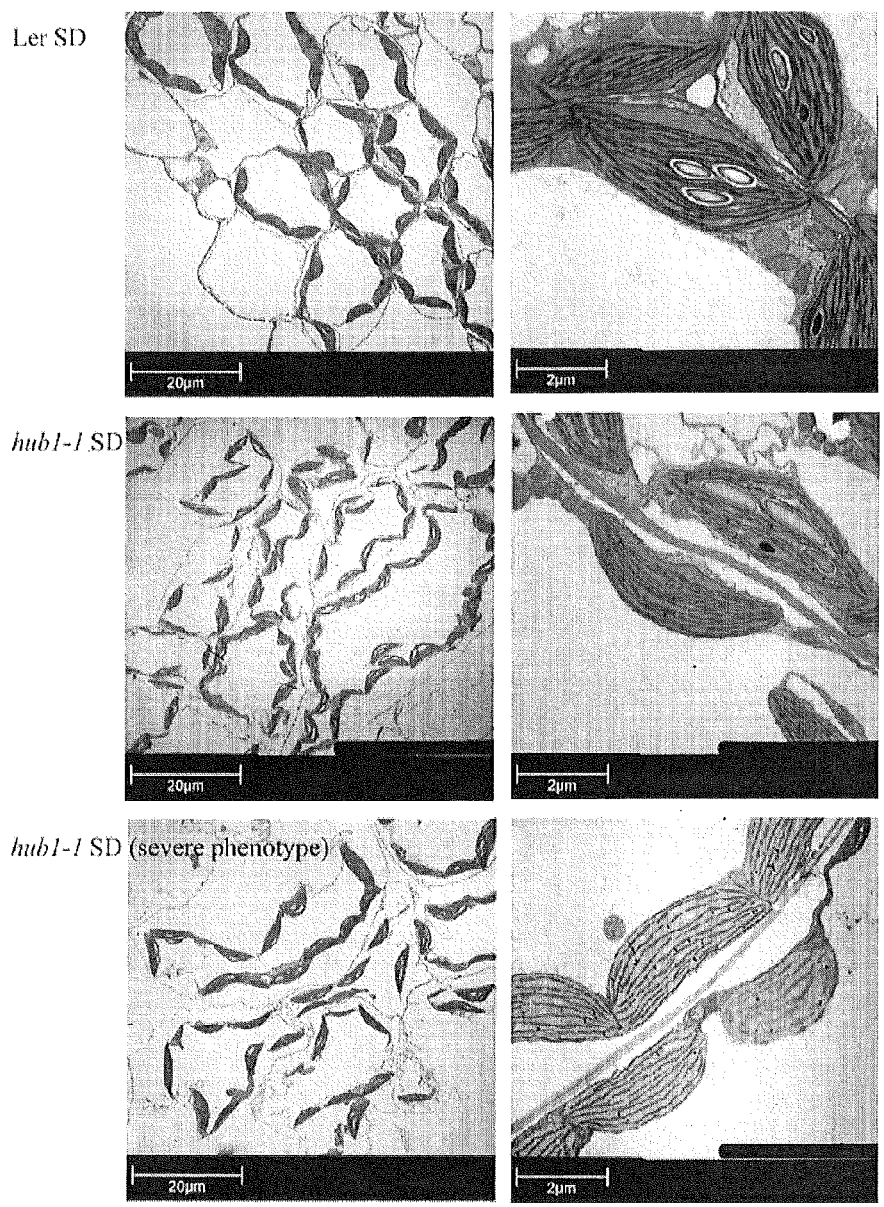

FIG. 8 TEM images of SD grown Ler and hub1-1 leaves.

Figure 9:
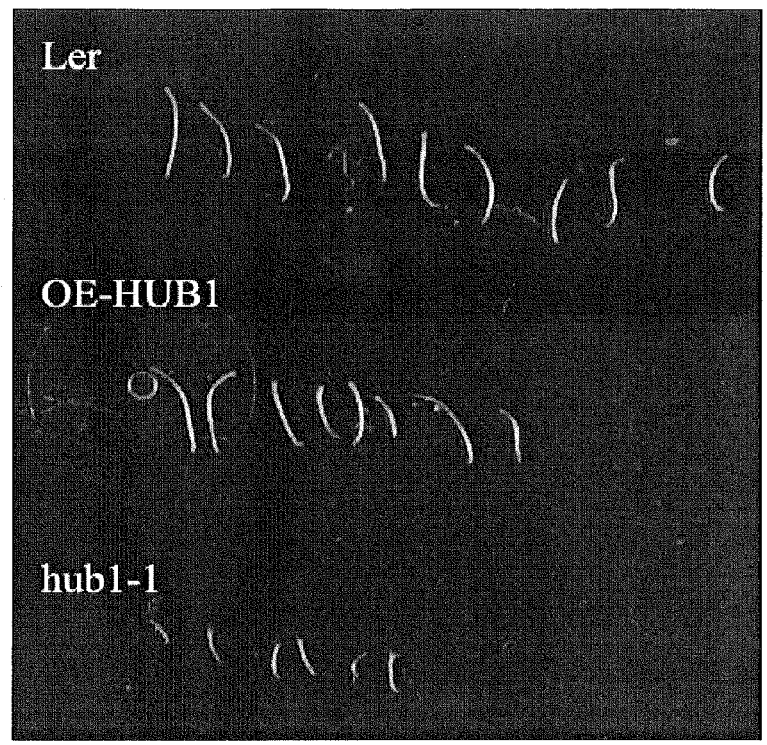

FIG. 9 Extracted hypocotyls of short day grown 21 days old Ler, OE-HUB1 and hub1-1 plants.

Figure 10:
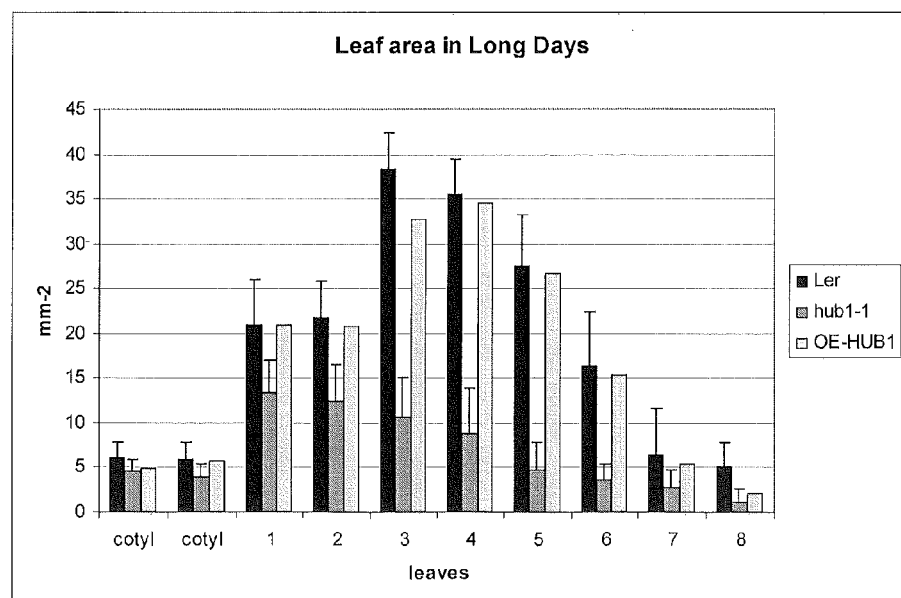

FIG. 10 Leaf area measurements of Ler, hub1-1 and OE-HUB1 in vitro grown seedlings under long day conditions.

Figure 11:
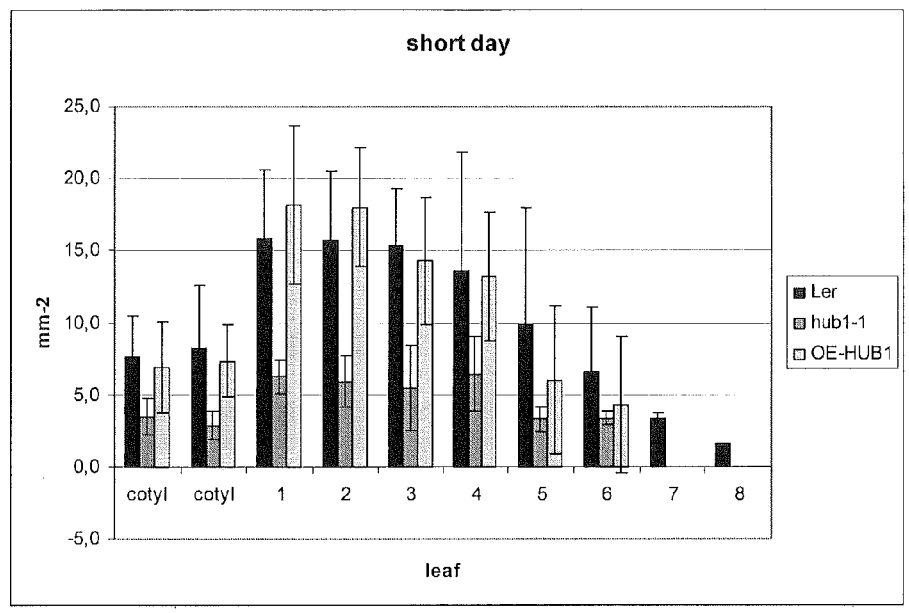

FIG. 11 Leaf area measurements of Ler, hub1-1 and OE-HUB1 in vitro grown seedlings under short day conditions.

Figure 12:

FIG. 12 Spike-like structures (arrow) on the abaxial side of narrow hub1-1 leaves from SD grown in vitro plants.

Figure 13:
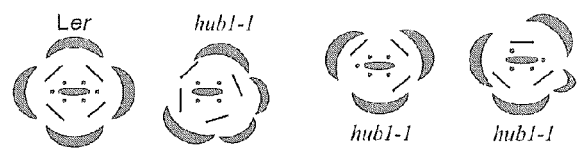

FIG. 13 Diagrams of hub1-1 and wild type Ler flowers.

Figure 14:
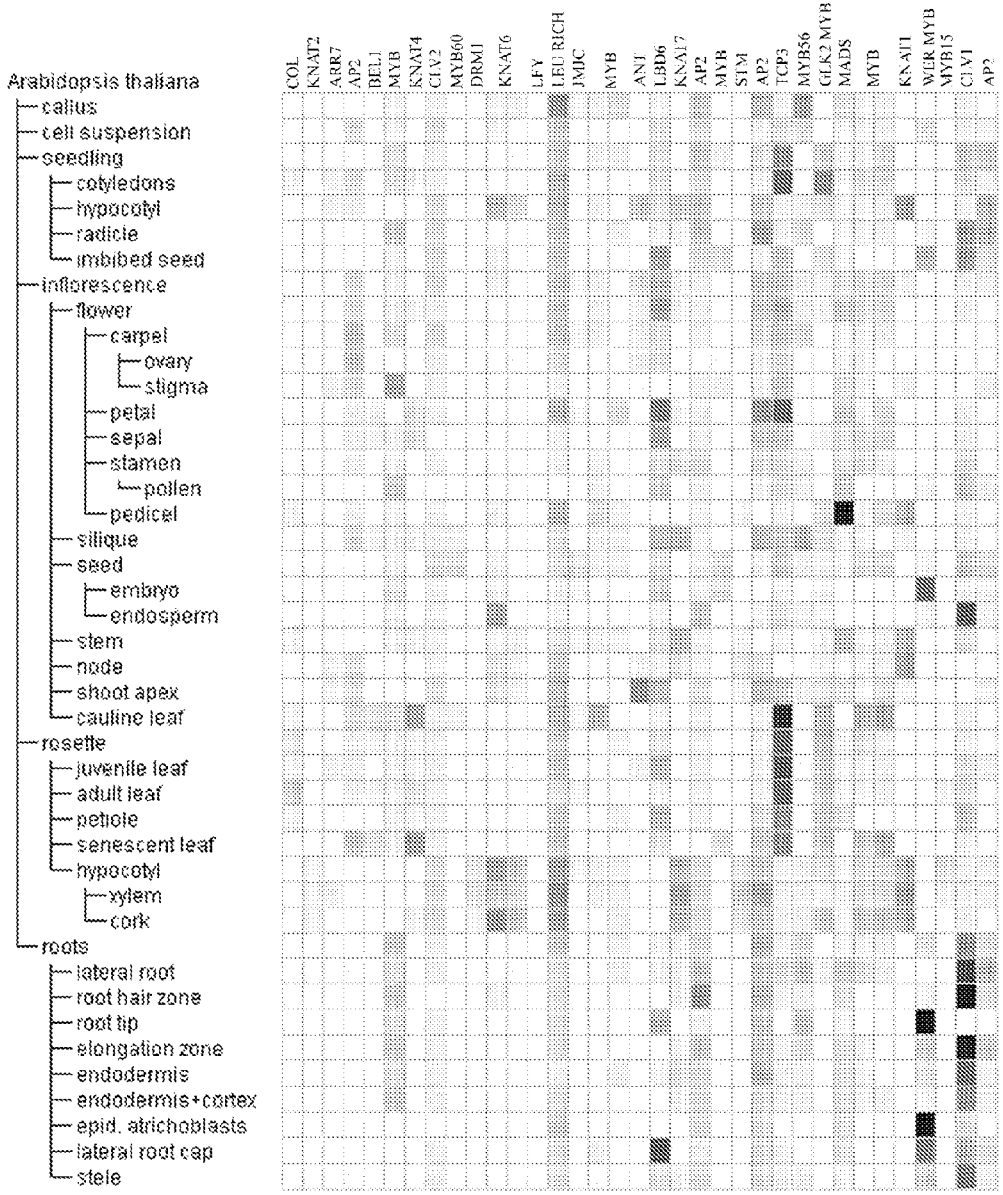

FIG. 14 organ specific expression patterns of differentially expressed developmental genes in HUB1.

Figure 15:
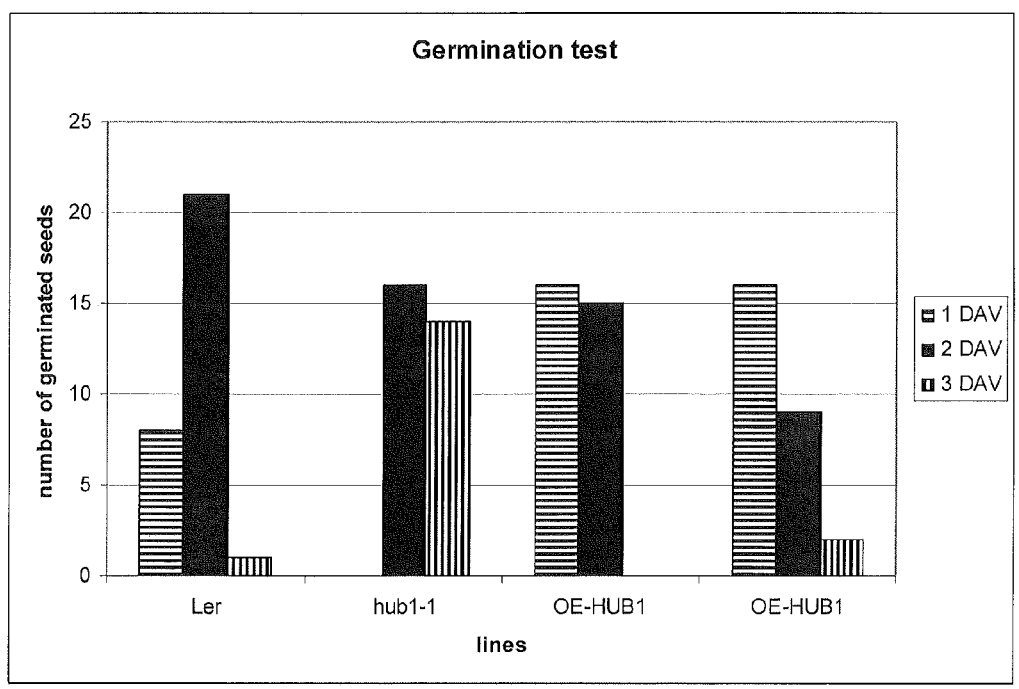

FIG. 15 Germination vigour in *Arabidopsis* HUB1 lines. DAV=days after vernalisation. (n=30). OE7a and OE17x5 are HUB1 overexpressing lines, Ler and hub1 (mutant) are controls.

Figure 16:
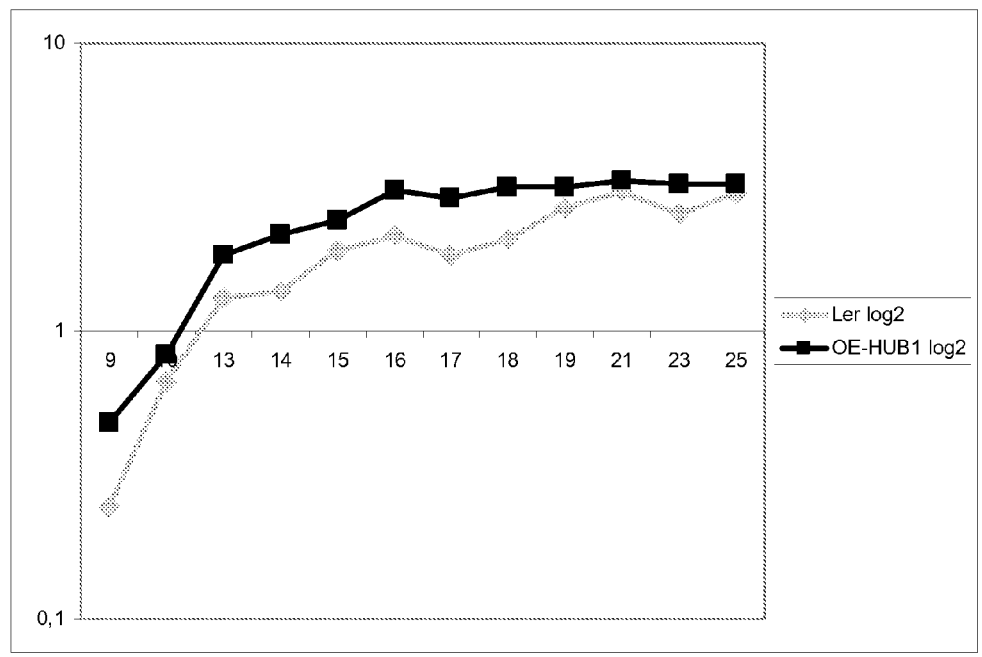

FIG. 16 Epidermal cell size in *Arabidopsis* Ler wild type and OE-HUB1 lines presented as log 2 transformed values.

Figure 17:
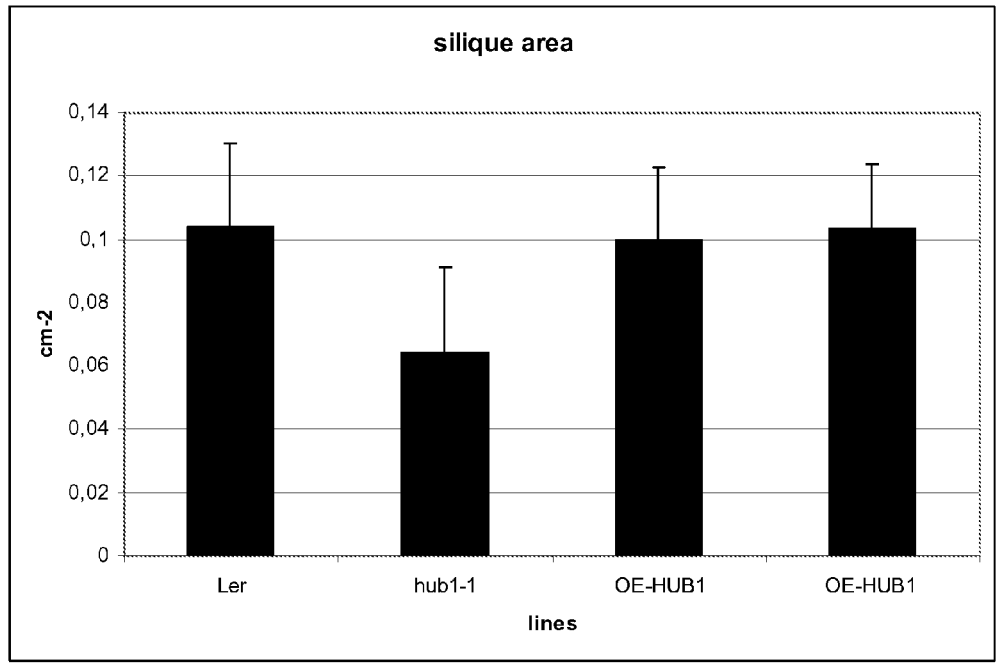

FIG. 17 Silique area measurements of *Arabidopsis* Ler wild type, hub1-1 mutant and two overexpression HUB1 lines.

Figure 18:
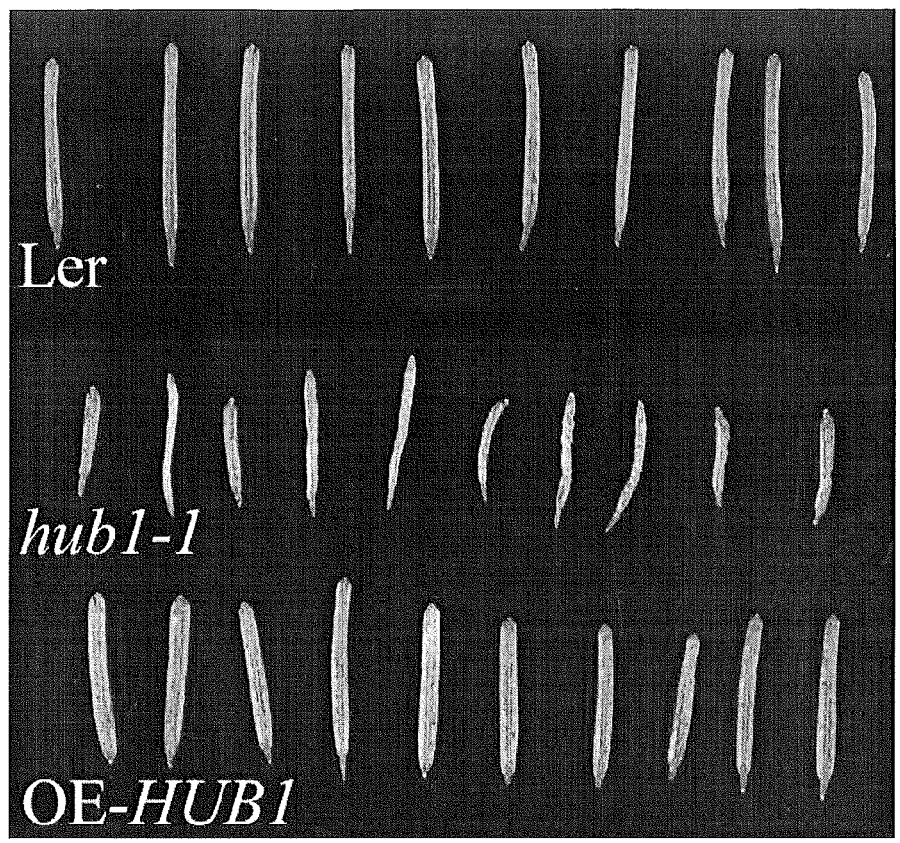

FIG. 18 Siliques of Ler wild type, hub1-1 mutant and HUB1 overexpression lines.

Figure 19:
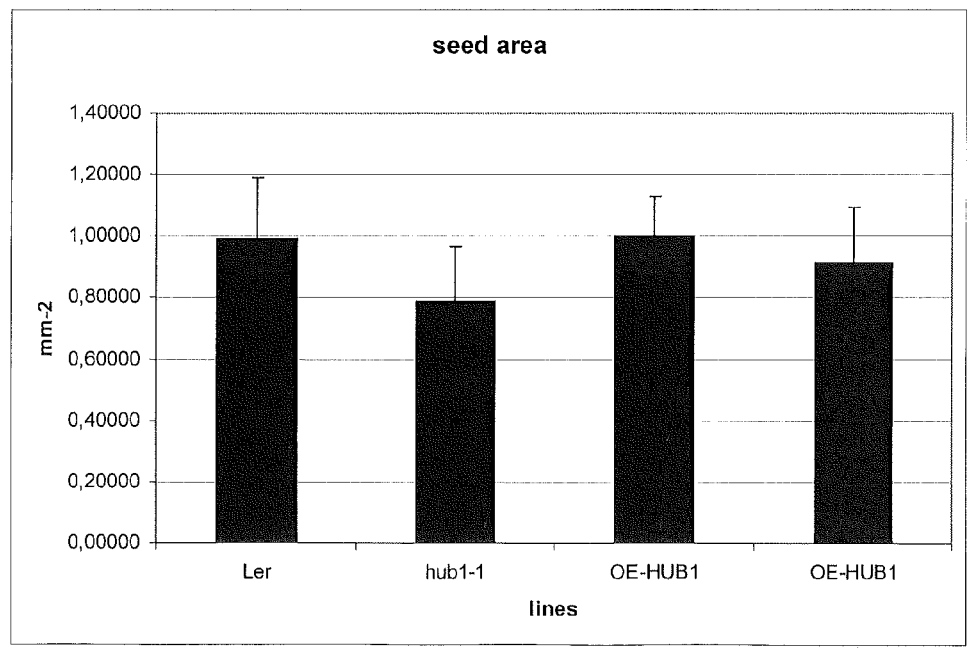

FIG. 19 Seed area measurements of Ler wild type, hub1-1 mutant and two HUB1 overexpression lines.

Figure 20:
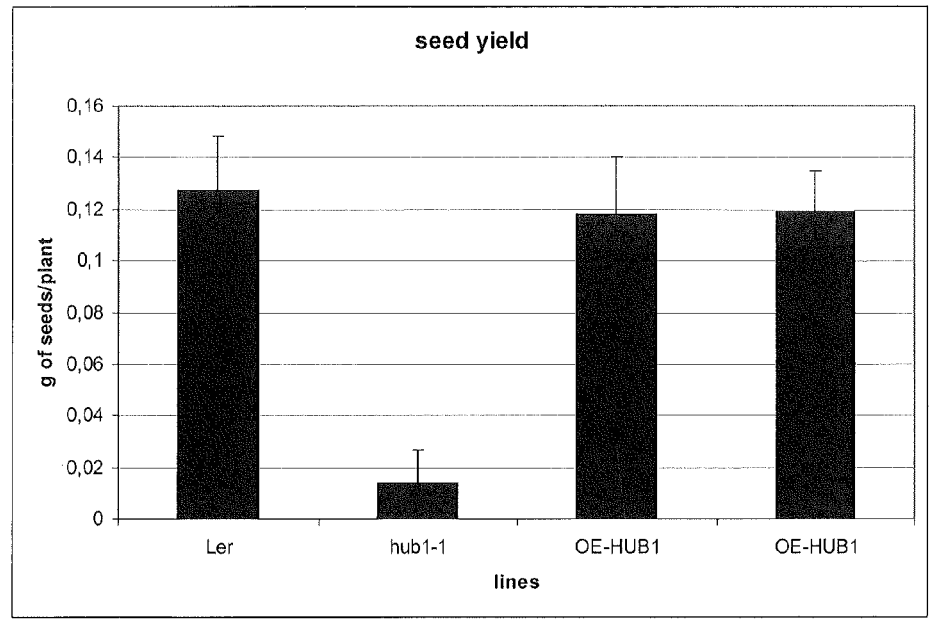
Figure 21:
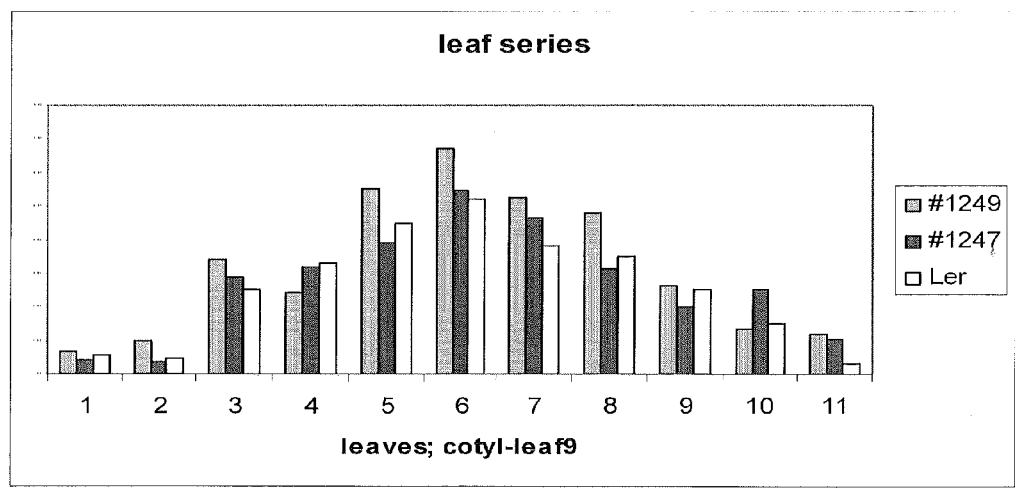
Figure 21:
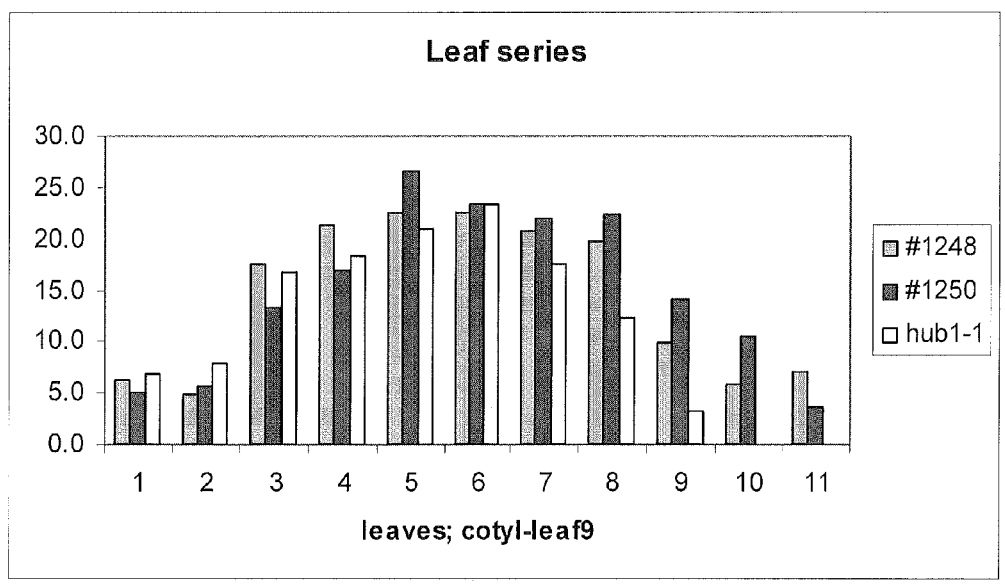

FIG. 20 Seed yield (grams of seeds per plant) for Ler wild type, the hub1-1 mutant and two HUB1 overexpression lines FIG. 21 Panel A shows the effect on leaf width of HUB1 and HUB1pm overexpression in wild type (Ler) background; #1247 represents a HUB1 overexpressing line and #1249 is the HUB1pm overexpressing line. Untransformed Ler served as control. Panel B shows that mature leaf width is affected by overexpressing HUB1pm in the hub1-1 mutant background. #1248 represents a WT HUB1 overexpressing line in a hub1-1 background, #1250 represent the HUB1pm overexpressing line in a hub1-1 background. Untransformed hub1-1 served as control. Numbers 1 to 11 represent the two cotyls and leaves 1 to 9 of the rosette.

Figure 22:
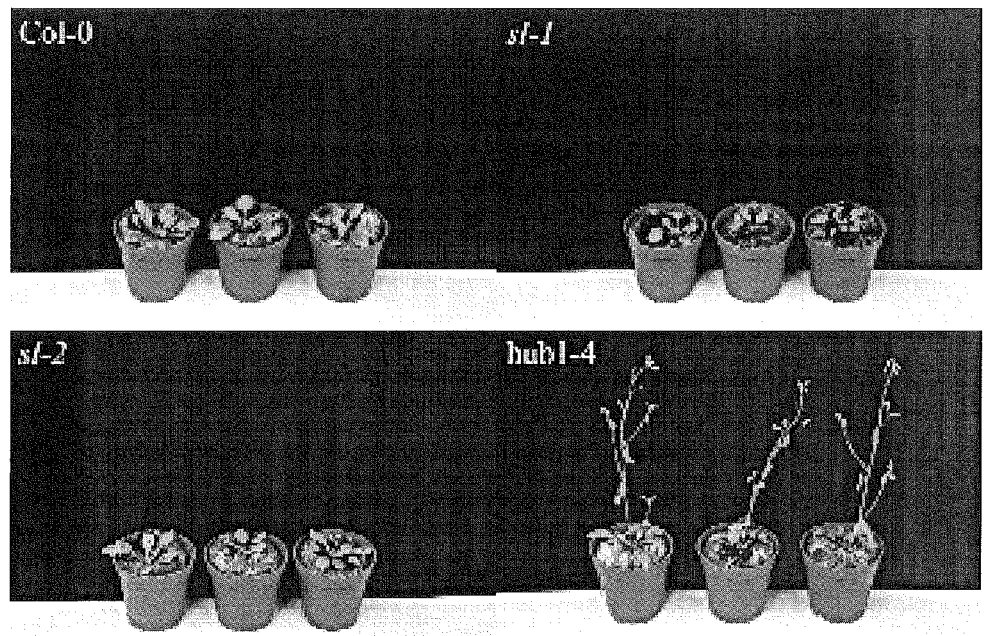
Figure 22:
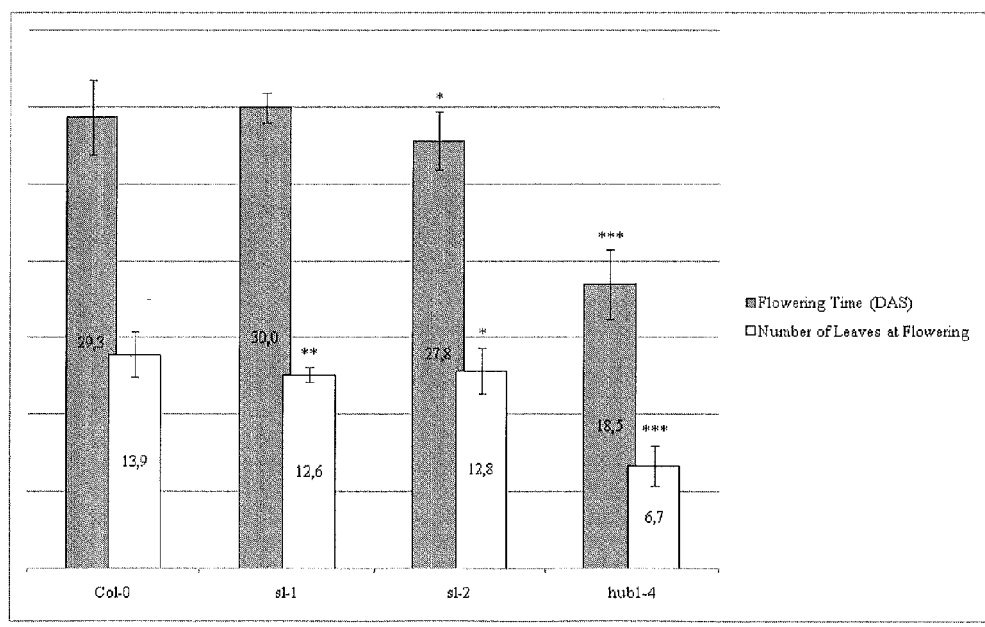
Figure 22:
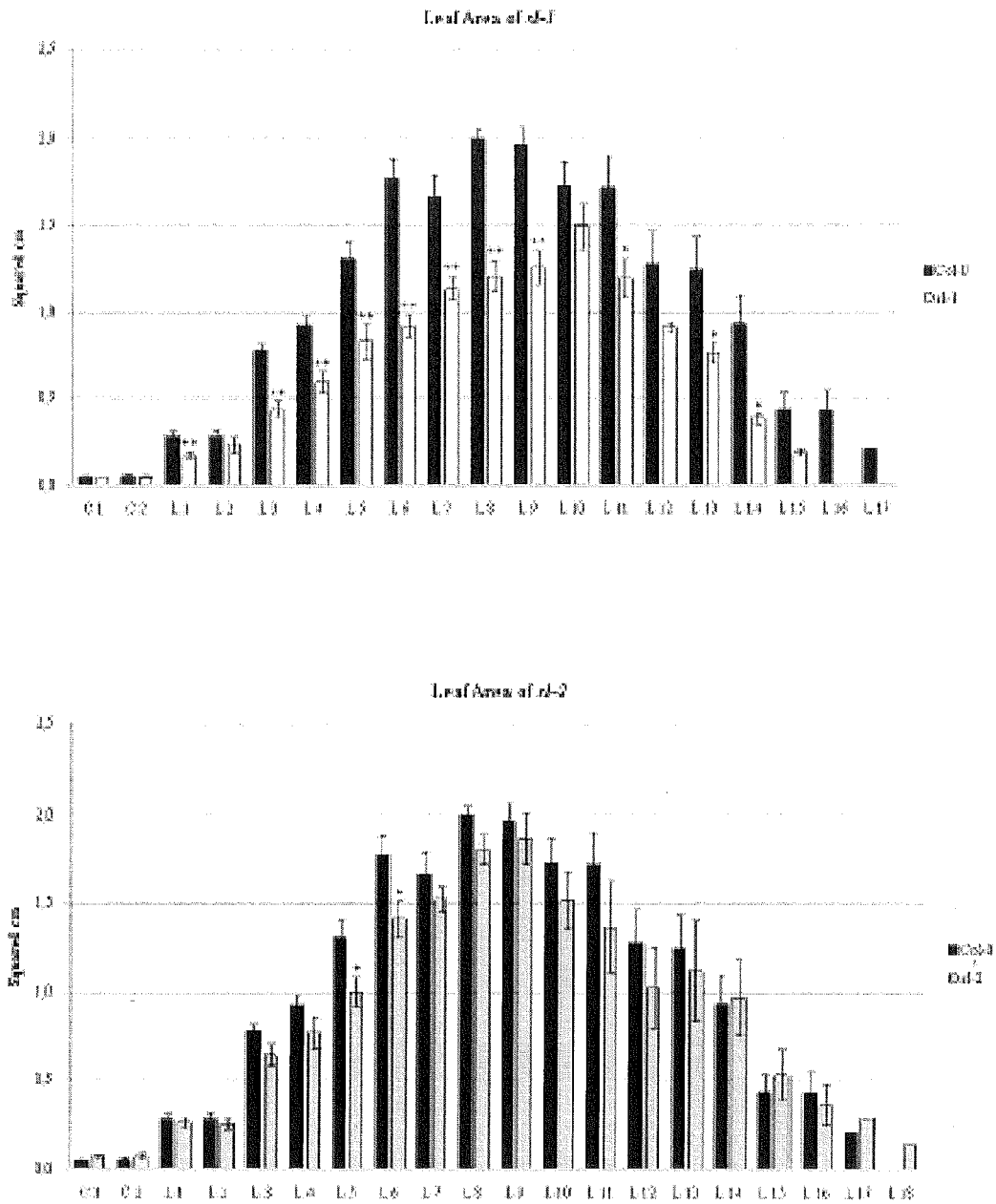
Figure 22:
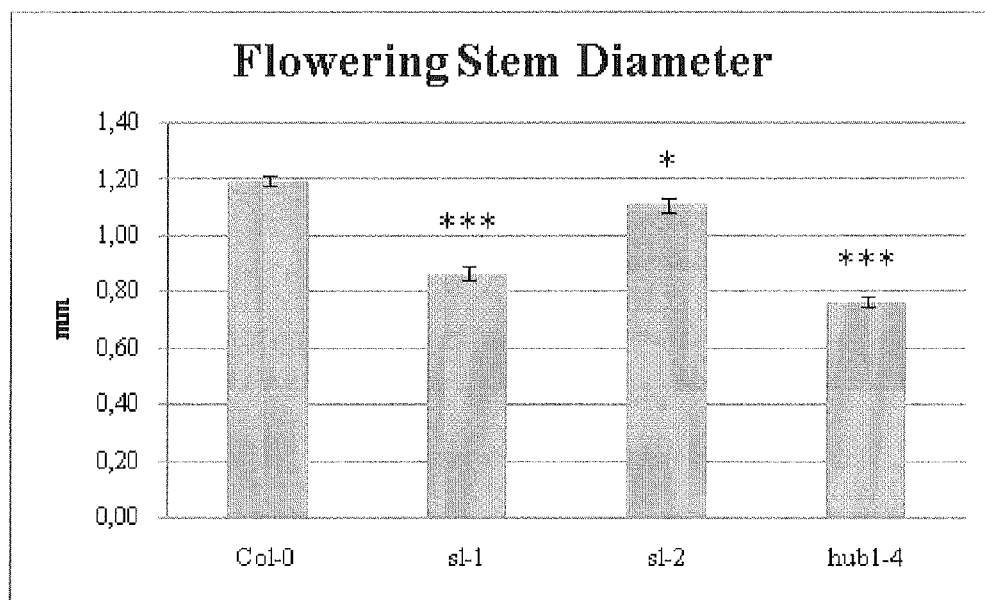

FIG. 22 Phenotypic characterization of sl-1 and sl-2 T-DNA insertion lines in comparison with Col-0 and hub1-4 mutant. A—Whole plant picture of all the four genotypes at WT, sl-1 and sl-2 flowering time (28 DAS). B—The flowering time analysis of the four lines evidences that hub1-4 flowers much earlier than the other ones (also shown in A) except for a very slight reduction in sl-2. On the other hand, the number of rosette leaves at flowering has a different trend for all the mutant lines since a significant reduction of it is reported for sl-1, sl-2 and hub1-4. C—Leaf area of sl-1 is severely reduced for almost all leaves whereas in the case of sl-2 the reduction is much less as just in few leaves the reduction was shown to be significant. Upper panel: bars in black are Col-0, bars in white are sl-1; bottom panel: bars in black are Col-0, bars in grey are sl-2. D—The flower stem diameter of sl-1 and sl-2 is also reduced compared to wild type plants. All Student's T-test performed with a level of significance of 5% (p=0.05).

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence of SEQ ID NO: 1 or the Protein of SEQ ID NO: 2

Sequences (full length cDNA, ESTs or genomic) related to the nucleic acid sequence used in the methods of the present invention were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A provides a list of nucleic acid sequences related to the nucleic acid sequence of SEQ ID NO: 1 and the protein of SEQ ID NO: 2.

TABLE A

Examples of HUB1 polypeptides:

| Identifier, Plant Source | Nucleic acid | Protein |
|---|---|---|
| At2g44950, *Arabidopsis thaliana* (HUB1) | SEQ ID NO: 1 | SEQ ID NO: 2 |
| scaff_40.53#1, *Populus* sp. | SEQ ID NO: 29 | SEQ ID NO: 8 |
| TA45131_4081#1, *Solanum lycopersicum* | SEQ ID NO: 30 | SEQ ID NO: 9 |
| LOC_Os04g46450.1#1, *Oryza sativa* | SEQ ID NO: 31 | SEQ ID NO: 10 |
| CAO70576.1, *Vitis vinifera* | SEQ ID NO: 32 | SEQ ID NO: 11 |
| EDQ74097.1, *Physcomitrella patens* subsp. *patens* | SEQ ID NO: 33 | SEQ ID NO: 12 |
| XP_001754625.1, *Physcomitrella patens* subsp. *patens* | SEQ ID NO: 34 | SEQ ID NO: 13 |
| XP_001777122.1, *Physcomitrella patens* subsp. *patens* | SEQ ID NO: 35 | SEQ ID NO: 14 |
| CAO22034.1, *Vitis vinifera* | SEQ ID NO: 36 | SEQ ID NO: 15 |
| AAL91211, *Arabidopsis thaliana* | SEQ ID NO: 37 | SEQ ID NO: 16 |
| AAG51572.1, *Arabidopsis thaliana* (HUB2) | SEQ ID NO: 38 | SEQ ID NO: 17 |
| ABE92765.2, *Medicago truncatula* | SEQ ID NO: 39 | SEQ ID NO: 18 |
| CAD41603.3, *Oryza sativa* (*japonica* cultivar-group) | SEQ ID NO: 40 | SEQ ID NO: 19 |
| ABB47997.1, *Oryza sativa* (*japonica* cultivar-group) | SEQ ID NO: 41 | SEQ ID NO: 20 |
| CAA98640.1, *Saccharomyces cerevisiae* (BRE1) | SEQ ID NO: 42 | SEQ ID NO: 21 |
| NP_587845.1, *Schizosaccharomyces pombe* | SEQ ID NO: 43 | SEQ ID NO: 22 |
| AAK21443.1, *Caenorhabditis elegans* | SEQ ID NO: 44 | SEQ ID NO: 23 |
| AAF50744.2, *Drosophila melanogaster* | SEQ ID NO: 45 | SEQ ID NO: 24 |
| BAB14005.1, *Homo sapiens* | SEQ ID NO: 46 | SEQ ID NO: 25 |
| AAH18647.1, *Homo sapiens* | SEQ ID NO: 47 | SEQ ID NO: 26 |
| AC144591, *Medicago truncatula* | SEQ ID NO: 48 | SEQ ID NO: 27 |
| At2g44950 *Arabidopsis thaliana* point mutation | SEQ ID NO: 49 | SEQ ID NO: 28 |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid or polypeptide sequence of interest.

Example 2

Alignment of HUB1 Polypeptide Sequences

Alignment of polypeptide sequences was performed using the ClustalW 2.0 algorithm of progressive alignment (Larkin et al., Bioinformatics 23, 2947-2948, 2007). Default values are for the gap open penalty of 10, for the gap extension penalty of 0.1 and the selected weight matrix is Gonnet (if polypeptides are aligned). Minor manual editing may be done to further optimise the alignment. Sequence conservation among HUB1 polypeptides is essentially in the C-terminal RING domain of the polypeptides, the N-terminal domain usually being more variable in sequence length and composition. The HUB1 polypeptides are aligned in FIG. 2.

A phylogenetic tree of HUB1 polypeptides (FIG. 3) was constructed from the alignment using a neighbour-joining clustering algorithm as provided in the ClustalW 2.0 program. The figures give the bootstrap values for 1000 repetitions.

Example 3

Calculation of Global Percentage Identity Between HUB1 Polypeptide Sequences

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B1 for the global similarity and identity over the full length of the polypeptide sequences. Percentage identity is given above the diagonal and percentage similarity is given below the diagonal.

The percentage identity between the HUB1 polypeptide sequences useful in performing the methods of the invention can be as low as 18% amino acid identity compared to SEQ ID NO: 2 (At2g44950); however, when only the RING domains are compared the identity is much higher (Table B2). It should be noted however that yeast BRE1 (CAA98640), the functional orthologue of HUB1 (At2g44950) has only 18.6% sequence identity with HUB1.

TABLE B1

MatGAT results for global similarity and identity over the full length of the HUB1 polypeptide sequences.

| | 1 | 2 | 3 | 4 | 5 | 6 | 7 | 8 | 9 | 10 | 11 |
|---|---|---|---|---|---|---|---|---|---|---|---|
| 1. At2g44950 | | 54.5 | 37.0 | 43.2 | 33.1 | 56.2 | 35.3 | 35.1 | 34.5 | 19.0 | 99.9 |
| 2. scaff_40.53 | 72.8 | | 40.3 | 45.5 | 37.0 | 66.2 | 35.7 | 35.4 | 34.5 | 21.2 | 54.5 |
| 3. TA45131_4081 | 49.2 | 52.3 | | 33.1 | 54.2 | 46.1 | 29.2 | 25.4 | 25.2 | 15.2 | 37.1 |

TABLE B1-continued

MatGAT results for global similarity and identity over the full length of the HUB1 polypeptide sequences.

| | | | | | | | | | | | |
|---|---|---|---|---|---|---|---|---|---|---|---|
| 4. LOC_Os04g46450 | 63.3 | 65.8 | 47.2 | | 30.7 | 49.0 | 32.6 | 33.2 | 31.8 | 19.1 | 43.3 |
| 5. AC144591 | 47.7 | 48.6 | 71.4 | 45.6 | | 39.9 | 26.8 | 24.0 | 24.5 | 14.0 | 33.1 |
| 6. CAO70576 | 73.9 | 81.5 | 54.7 | 69.3 | 51.3 | | 36.6 | 35.9 | 33.8 | 21.3 | 56.2 |
| 7. EDQ74097 | 58.8 | 58.8 | 46.8 | 55.4 | 43.7 | 59.1 | | 47.2 | 47.4 | 23.5 | 35.2 |
| 8. XP_001754625 | 58.0 | 57.6 | 42.1 | 55.4 | 38.9 | 59.0 | 66.6 | | 64.2 | 22.0 | 35.0 |
| 9. XP_001777122 | 59.0 | 56.6 | 41.4 | 54.6 | 39.6 | 58.4 | 66.4 | 77.3 | | 20.6 | 34.5 |
| 10. CAO22034 | 30.6 | 32.6 | 23.4 | 30.3 | 22.3 | 33.2 | 33.9 | 33.3 | 32.9 | | 19.1 |
| 11. AAL91211 | 100.0 | 72.8 | 49.2 | 63.3 | 47.7 | 73.9 | 58.8 | 57.8 | 59.0 | 30.6 | |
| 12. AAG51572 | 52.4 | 55.5 | 39.7 | 52.3 | 37.5 | 57.0 | 57.5 | 56.5 | 55.5 | 43.0 | 52.4 |
| 13. ABE92765 | 49.7 | 50.1 | 71.9 | 46.7 | 95.3 | 52.4 | 45.5 | 40.5 | 40.6 | 23.4 | 49.7 |
| 14. CAD41603 | 59.7 | 61.4 | 44.4 | 94.1 | 43.6 | 64.9 | 52.0 | 53.1 | 51.6 | 28.8 | 59.7 |
| 15. ABB47997 | 50.9 | 54.8 | 42.7 | 51.8 | 39.3 | 55.9 | 65.0 | 57.2 | 56.8 | 40.1 | 50.9 |
| 16. CAA98640 | 38.7 | 38.6 | 40.4 | 38.0 | 39.6 | 38.0 | 37.6 | 36.2 | 37.3 | 23.2 | 38.7 |
| 17. NP_587845 | 38.2 | 37.1 | 41.3 | 37.4 | 42.1 | 36.0 | 39.4 | 38.9 | 37.3 | 21.4 | 38.6 |
| 18. AAK21443 | 42.4 | 41.0 | 37.6 | 39.1 | 34.2 | 41.9 | 42.2 | 42.1 | 42.6 | 25.7 | 42.4 |
| 19. AAF50744 | 40.4 | 40.2 | 31.3 | 39.7 | 29.6 | 41.4 | 38.3 | 40.9 | 40.1 | 29.7 | 40.4 |
| 20. BAB14005 | 39.3 | 41.4 | 40.3 | 40.4 | 38.5 | 41.6 | 42.1 | 41.7 | 41.3 | 24.7 | 39.3 |
| 21. AAH18647 | 40.9 | 41.8 | 32.1 | 41.1 | 29.1 | 41.9 | 41.2 | 43.3 | 43.2 | 28.7 | 40.9 |

| | 12 | 13 | 14 | 15 | 16 | 17 | 18 | 19 | 20 | 21 |
|---|---|---|---|---|---|---|---|---|---|---|
| 1. At2g44950 | 29.3 | 34.4 | 38.2 | 29.4 | 18.6 | 18.2 | 20.5 | 19.9 | 20.6 | 22.7 |
| 2. scaff_40.53 | 31.9 | 38.2 | 40.4 | 32.3 | 19.4 | 18.7 | 20.1 | 21.4 | 21.6 | 21.9 |
| 3. TA45131_4081 | 24.4 | 53.3 | 29.3 | 26.4 | 18.1 | 19.0 | 19.6 | 17.8 | 21.6 | 18.9 |
| 4. LOC_Os04g46450 | 30.5 | 31.4 | 89.0 | 30.9 | 19.6 | 19.3 | 19.3 | 19.1 | 21.0 | 21.7 |
| 5. AC144591 | 21.6 | 94.5 | 28.9 | 23.6 | 19.5 | 20.0 | 16.7 | 15.6 | 22.2 | 17.2 |
| 6. CAO70576 | 33.4 | 40.9 | 43.7 | 34.2 | 18.9 | 19.2 | 20.4 | 21.0 | 22.0 | 21.7 |
| 7. EDQ74097 | 38.4 | 27.7 | 29.3 | 41.5 | 17.8 | 20.6 | 19.7 | 22.3 | 23.5 | 24.1 |
| 8. XP_001754625 | 34.7 | 25.0 | 30.8 | 36.0 | 18.9 | 20.0 | 21.6 | 23.8 | 22.9 | 24.8 |
| 9. XP_001777122 | 32.1 | 25.3 | 28.9 | 33.3 | 16.6 | 17.0 | 21.2 | 20.2 | 22.0 | 23.8 |
| 10. CAO22034 | 34.4 | 14.9 | 17.8 | 30.1 | 13.6 | 12.5 | 13.5 | 16.1 | 14.0 | 16.4 |
| 11. AAL91211 | 29.3 | 34.4 | 38.4 | 29.4 | 18.6 | 18.5 | 20.6 | 19.8 | 20.5 | 22.6 |
| 12. AAG51572 | | 23.7 | 27.3 | 46.4 | 19.0 | 19.0 | 21.2 | 21.2 | 21.4 | 20.8 |
| 13. ABE92765 | 39.0 | | 29.6 | 25.1 | 18.6 | 20.4 | 18.1 | 15.7 | 23.2 | 19.3 |
| 14. CAD41603 | 49.3 | 44.3 | | 27.5 | 19.1 | 18.7 | 20.2 | 19.1 | 20.1 | 21.3 |
| 15. ABB47997 | 67.6 | 41.2 | 49.2 | | 18.5 | 20.1 | 18.7 | 20.2 | 21.3 | 20.9 |
| 16. CAA98640 | 37.9 | 39.6 | 37.4 | 37.7 | | 23.8 | 19.5 | 18.4 | 20.2 | 18.3 |
| 17. NP_587845 | 36.4 | 39.1 | 37.5 | 39.8 | 45.6 | | 19.2 | 18.4 | 19.2 | 17.5 |
| 18. AAK21443 | 39.4 | 35.4 | 39.4 | 41.9 | 38.4 | 38.1 | | 22.8 | 24.3 | 22.9 |
| 19. AAF50744 | 40.6 | 30.0 | 39.9 | 38.9 | 33.7 | 33.7 | 41.9 | | 36.2 | 43.8 |
| 20. BAB14005 | 41.7 | 39.1 | 38.8 | 43.1 | 41.7 | 39.8 | 43.5 | 50.6 | | 47.3 |
| 21. AAH18647 | 41.1 | 30.8 | 40.0 | 40.5 | 35.3 | 33.3 | 42.4 | 61.9 | 58.5 | |

TABLE B2

MatGAT results for similarity and identity over the RING domains of the HUB1 polypeptide sequences.

| | 1 | 2 | 3 | 4 | 5 | 6 | 7 | 8 | 9 | 10 | 11 |
|---|---|---|---|---|---|---|---|---|---|---|---|
| 1. XP_001754625 | | 73.7 | 81.6 | 81.6 | 78.9 | 86.8 | 65.8 | 65.8 | 63.2 | 63.2 | 76.3 |
| 2. XP_001777122 | 86.8 | | 71.1 | 68.4 | 65.8 | 71.1 | 55.3 | 55.3 | 50.0 | 50.0 | 68.4 |
| 3. EDQ74097 | 92.1 | 81.6 | | 81.6 | 73.7 | 84.2 | 63.2 | 63.2 | 57.9 | 57.9 | 71.1 |
| 4. CAO22034 | 86.8 | 76.3 | 86.8 | | 89.5 | 89.5 | 68.4 | 68.4 | 65.8 | 65.8 | 76.3 |
| 5. AAG51572 | 84.2 | 76.3 | 81.6 | 92.1 | | 86.8 | 71.1 | 71.1 | 60.5 | 60.5 | 71.1 |
| 6. ABB47997 | 92.1 | 81.6 | 86.8 | 94.7 | 92.1 | | 65.8 | 65.8 | 63.2 | 63.2 | 73.7 |
| 7. LOC_Os04g46450 | 78.9 | 76.3 | 81.6 | 81.6 | 78.9 | 81.6 | | 100.0 | 68.4 | 68.4 | 65.8 |
| 8. CAD41603 | 78.9 | 76.3 | 81.6 | 81.6 | 78.9 | 81.6 | 100.0 | | 68.4 | 68.4 | 65.8 |
| 9. At2g44950 | 73.7 | 71.1 | 73.7 | 73.7 | 68.4 | 73.7 | 81.6 | 81.6 | | 100.0 | 65.8 |
| 10. AAL91211 | 73.7 | 71.1 | 73.7 | 73.7 | 68.4 | 73.7 | 81.6 | 81.6 | 100.0 | | 65.8 |
| 11. scaff_40.53 | 84.2 | 84.2 | 81.6 | 84.2 | 76.3 | 84.2 | 76.3 | 76.3 | 78.9 | 78.9 | |
| 12. CAO70576 | 84.2 | 81.6 | 84.2 | 86.8 | 81.6 | 89.5 | 81.6 | 81.6 | 81.6 | 81.6 | 92.1 |
| 13. TA45131_4081 | 78.9 | 76.3 | 76.3 | 78.9 | 73.7 | 78.9 | 71.1 | 71.1 | 71.1 | 71.1 | 84.2 |
| 14. AC144591 | 81.6 | 71.1 | 73.7 | 71.1 | 68.4 | 73.7 | 81.6 | 81.6 | 81.6 | 81.6 | 78.9 |
| 15. ABE92765 | 81.6 | 71.1 | 73.7 | 71.1 | 68.4 | 73.7 | 81.6 | 81.6 | 81.6 | 81.6 | 78.9 |
| 16. BAB14005 | 63.2 | 65.8 | 65.8 | 60.5 | 63.2 | 63.2 | 71.1 | 71.1 | 68.4 | 68.4 | 68.4 |
| 17. AAH18647 | 63.2 | 65.8 | 65.8 | 60.5 | 63.2 | 63.2 | 71.1 | 71.1 | 65.8 | 65.8 | 68.4 |
| 18. AAF50744 | 65.8 | 63.2 | 63.2 | 60.5 | 60.5 | 63.2 | 65.8 | 65.8 | 68.4 | 68.4 | 68.4 |
| 19. AAK21443 | 63.2 | 57.9 | 60.5 | 65.8 | 68.4 | 63.2 | 60.5 | 60.5 | 71.1 | 71.1 | 68.4 |
| 20. CAA98640 | 52.6 | 50.0 | 55.3 | 50.0 | 52.6 | 50.0 | 55.3 | 55.3 | 52.6 | 52.6 | 52.6 |
| 21. NP_587845 | 66.7 | 66.7 | 69.2 | 64.1 | 66.7 | 66.7 | 69.2 | 69.2 | 64.1 | 64.1 | 71.8 |

TABLE B2-continued

MatGAT results for similarity and identity over the
RING domains of the HUB1 polypeptide sequences.

|  | 12 | 13 | 14 | 15 | 16 | 17 | 18 | 19 | 20 | 21 |
|---|---|---|---|---|---|---|---|---|---|---|
| 1. XP_001754625 | 68.4 | 65.8 | 68.4 | 68.4 | 44.7 | 47.4 | 42.1 | 47.4 | 42.1 | 48.7 |
| 2. XP_001777122 | 57.9 | 52.6 | 55.3 | 55.3 | 39.5 | 42.1 | 36.8 | 44.7 | 34.2 | 43.6 |
| 3. EDQ74097 | 65.8 | 60.5 | 63.2 | 63.2 | 50.0 | 52.6 | 47.4 | 47.4 | 42.1 | 51.3 |
| 4. CAO22034 | 73.7 | 68.4 | 65.8 | 65.8 | 42.1 | 44.7 | 42.1 | 50.0 | 39.5 | 48.7 |
| 5. AAG51572 | 68.4 | 63.2 | 63.2 | 63.2 | 42.1 | 44.7 | 42.1 | 50.0 | 39.5 | 51.3 |
| 6. ABB47997 | 71.1 | 63.2 | 63.2 | 63.2 | 47.4 | 50.0 | 44.7 | 47.4 | 39.5 | 48.7 |
| 7. LOC_Os04g46450 | 68.4 | 60.5 | 76.3 | 76.3 | 44.7 | 44.7 | 39.5 | 47.4 | 36.8 | 51.3 |
| 8. CAD41603 | 68.4 | 60.5 | 76.3 | 76.3 | 44.7 | 44.7 | 39.5 | 47.4 | 36.8 | 51.3 |
| 9. At2g44950 | 68.4 | 60.5 | 71.1 | 71.1 | 52.6 | 50.0 | 42.1 | 50.0 | 36.8 | 46.2 |
| 10. AAL91211 | 68.4 | 60.5 | 71.1 | 71.1 | 52.6 | 50.0 | 42.1 | 50.0 | 36.8 | 46.2 |
| 11. scaff_40.53 | 78.9 | 76.3 | 76.3 | 76.3 | 47.4 | 50.0 | 44.7 | 50.0 | 39.5 | 46.2 |
| 12. CAO70576 |  | 65.8 | 68.4 | 68.4 | 47.4 | 52.6 | 42.1 | 47.4 | 39.5 | 46.2 |
| 13. TA45131_4081 | 81.6 |  | 68.4 | 68.4 | 42.1 | 42.1 | 44.7 | 44.7 | 31.6 | 46.2 |
| 14. AC144591 | 78.9 | 73.7 |  | 100.0 | 47.4 | 47.4 | 42.1 | 50.0 | 39.5 | 48.7 |
| 15. ABE92765 | 78.9 | 73.7 | 100.0 |  | 47.4 | 47.4 | 42.1 | 50.0 | 39.5 | 48.7 |
| 16. BAB14005 | 65.8 | 60.5 | 68.4 | 68.4 |  | 86.8 | 71.1 | 63.2 | 42.1 | 43.6 |
| 17. AAH18647 | 68.4 | 57.9 | 68.4 | 68.4 | 92.1 |  | 71.1 | 55.3 | 42.1 | 46.2 |
| 18. AAF50744 | 63.2 | 63.2 | 71.1 | 71.1 | 94.7 | 86.8 |  | 60.5 | 39.5 | 51.3 |
| 19. AAK21443 | 65.8 | 60.5 | 73.7 | 73.7 | 76.3 | 73.7 | 81.6 |  | 39.5 | 46.2 |
| 20. CAA98640 | 55.3 | 50.0 | 57.9 | 57.9 | 50.0 | 52.6 | 50.0 | 47.4 |  | 43.6 |
| 21. NP_587845 | 69.2 | 69.2 | 66.7 | 66.7 | 69.2 | 66.7 | 66.7 | 56.4 | 64.1 |  |

Example 4

Identification of Domains Comprised in HUB1 Polypeptide Sequences

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Pro-Dom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 2 are presented in Table C.

TABLE C

InterPro scan results (major accession numbers) of the polypeptide sequence as represented by SEQ ID NO: 2.

| Database | Accession number | Accession name | Amino acid coordinates on SEQ ID NO 2 |
|---|---|---|---|
| InterPro | IPR001093 | IMP dehydrogenase/GMP reductase |  |
| HMMPfam | PF00478.12 | IMP dehydrogenase/GMP reductase domainT | 368-761 |
| InterPro | IPR001841 | Zn-finger, RING |  |
| HMMPfam | PF00097.11 | Zinc finger, C3HC4 type (RING finger) | 826-864 |
| HMMSmart | SM00184 | no description | 826-864 |
| ProfileScan | PS50089 | ZF_RING_2 | 826-865 |
| ScanRegExp | PS00518 | ZF_RING_1 | 841-850 |
| InterPro | IPR009054 | Eukaryotic DNA topoisomerases I, dispensable insert |  |
| superfamily | SSF46596 | Eukaryotic DNA topoisomerase I, dispensable insert domainT | 598-664 |
| InterPro | IPR011072 | Protein kinase PKN/PRK1, effector |  |
| superfamily | SSF46585 | Effector domain of the protein kinase pkn/prk1T | 394-477 |
| superfamily | SSF57850 | RING/U-box | 803-877 |

Example 5

Topology Prediction of the HUB1 Polypeptide Sequences

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 2 are presented Table D. The "plant" organism group has been selected, no cutoffs defined, and the predicted length of the transit peptide requested. The subcellular localization of the polypeptide sequence as represented by SEQ ID NO: 2 may be the cytoplasm or nucleus, no transit peptide is predicted. Localisation experiments revealed that HUB1 is present in the nucleus (Liu et al., 2007).

TABLE D

TargetP 1.1 analysis of the polypeptide sequence as represented by SEQ ID NO: 2

| | |
|---|---|
| Length (AA) | 878 |
| Chloroplastic transit peptide | 0.133 |
| Mitochondrial transit peptide | 0.342 |
| Secretory pathway signal peptide | 0.017 |
| Other subcellular targeting | 0.635 |
| Predicted Location | / |
| Reliability class | 4 |
| Predicted transit peptide length | / |

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

Example 6

Functional Assay for the HUB1 Polypeptide

Based on sequence homologies, HUB1 had been previously identified as a BRE1 homolog (Hwang et al., 2003; Stone et al., 2005, Fleury et al., 2007). To confirm the suggested function as H2B monoubiquitinating E3 ligase, a series of in vitro ubiquitination assays were performed with epitope tagged recombinant HUB1 protein. In such type of assay, functional BRE1 E3 ligase is expected to ligate one ubiquitin molecule on histone H2B, causing a corresponding increase in H2B molecular weight (Zhu et al., Molecular Cell 20, 601-611, 2005).

cDNAs encoding HUB1 and the point mutated from (HUB1pm) were cloned into recombinant expression vectors with a GST or His epitope tags to allow purification with affinity chromatography. The GST-tagged protein was expressed in many fragments by E. coli and the His-tagged protein was precipitated in inclusion bodies. The insoluble His-tagged protein fraction was purified and refolded through a dialysis series with decreasing urea concentrations and bound to NiNTA beads (Invitrogen) in refolding buffer. During the HUB1 refolding the protein formed high molecular weight complexes suggesting that it forms dimers. This data is indicative that also in plants HUB1 activity may depend on homo- or heterodimerization as described for human Bret homologs (Zhu et al., 2005).

The purified proteins were subjected for self-ubiquitination assays in in vitro (auto)ubiquitination assays as well as histone H2B ubiquitination assays as described in Fleury et al., (2007). In this assay the purified HUB1 E3 ligase was combined with ubiquitin activating and conjugating enzymes (E1 and E2, respectively) and Ubiquitin in ATP containing buffer and was incubated for 1 hr at 37° C. with agitation. The reactions were stopped by boiling in SDS loading buffer and separated on 6% SDS-PAGE and transferred on membranes for hybridization with anti histone H2B or anti HA (against HA tagged ubiquitin) antibodies. The hybridization signals were detected by ECL (GE Healthcare) reagents and visualized on autoradiographic film (Amersham Hyperfilm ECL, GE Healthcare). Both His and GST protein fractions were enzymatically active and mediated histone H2B monoubiquitination in the in vitro ubiquitination assays (FIG. 5).

Both HUB1 and HUB1pm mediated monoubiquitination of histone H2B (17 kDa) that was seen as shift of H2B by 10 kDa in the protein gel blot (FIG. 5, HA-Ab below). This band of 27 kDa was reactive to both the H2B specific antibody and the HA antibody that detected the HA tagged ubiquitin. In the absence of E1, E2 or Ub, no shift in H2B migration was observed. Similar results were obtained in ubiquitination reactions with His tagged HUB1. Taken together these data confirmed that HUB1 is a functional homolog of human and yeast BRE1 proteins. Interestingly the point mutations (HUBpm) in the RING domain did not abolish the H2B monoubiquitination activity of HUB1.

In the histone H2B monoubiquitination assays with full length HUB1 and the point mutated form autoregulation of HUB1 was observed as high molecular weight modifications of the protein (FIG. 5, HA-Ab, above). These modifications were reactive to ubiquitin antibody suggesting that HUB1 has autopolyubiquitination activity. The pointmutations in the RING domain appeared to reduce the autopolyubiquitination activity as indicated by reduced levels of these modifications on the western blots (FIG. 5, HA-Ab, above). The equal loading of GST-HUB1 is shown by GST Ab (FIG. 5, GST-Ab). These data confirmed that the RING domain was required for the autoubiquitination activity.

Example 7

Cloning of the Nucleic Acid Sequence of SEQ ID NO: 1 for Rice Transformation

The HUB1 encoding nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm09774 (SEQ ID NO: 3; sense, start codon in bold): 5'-ggggacaagtttg tacaaaaaagcaggcttaaacaatg-gcgagcacaggcg-3' and prm09775 (SEQ ID NO: 4; reverse, complementary): 5'-ggggaccactttgtacaa-gaaagctgggttcatatgtagatag gtttaatatcattt-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pHUB1. Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice HMGP promoter (SEQ ID NO: 6) for constitutive expression was located upstream of this Gateway cassette.

After the LR recombination step, the resulting expression vector pHMGP::HUB1 (FIG. 4) was transformed into *Agrobacterium* strain LBA4044 according to methods well known in the art.

In a similar way, other genes disclosed in this invention can be cloned using primers comprising AttB sites for Gateway recombination. Design of such primers is known to persons skilled in the art.

Example 8

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 9

Phenotypic Evaluation Procedure for Rice Transformed with SEQ ID NO: 1

9.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting to satisfy plant needs to complete growth and development.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds are grown in potting soil under normal conditions until they approach the heading stage. They are then transferred to a "dry" section where irrigation is withheld. Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Growth and yield parameters are then measured.

9.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment—event—segregants). P values were obtained by comparing likelihood ratio test to chi square distributions.

9.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results are for plants three weeks post-germination. Germination vigour is measured as the number of germinating seeds after one, two or three days after sowing, compared to control plants.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 10

Results of the Phenotypic Evaluation of the Transgenic Rice Plants

The results of the evaluation of transgenic rice plants expressing a HUB1 nucleic acid under non-stress conditions are presented below in Table E. An increase of more than 5% was observed for emergence vigour (early vigour), total weight of seeds (total seed yield), number of filled seeds, and total number of seeds.

TABLE E improved growth parameters in transgenic rice expressing HUB1 under control of a medium strength promoter (HMGP):

| Parameter | % increase in T1 generation | % increase in T2 generation | p-value combined analysis |
|---|---|---|---|
| Emergence vigour | 18.9 | 35.8 | 0.007 |
| Total weight of seeds | 21.6 | 24.6 | 0.006 |
| Nr filled seeds | 20.6 | 24.6 | 0.006 |
| Total nr seeds | 13.8 | 22.7 | 0.021 |

When grown under stress conditions, the transgenic rice plants expressing HUB1 show, compared to control plants, in increase in one or more of the following parameters: aboveground area (or leafy biomass), early vigour, germination vigour, root biomass, total number of seeds, number of filled seeds, total seed yield (total weight of seeds), Thousand Kernel Weight, Harvest Index, number of flowers per panicle.

Example 11

Comparison of Promoter Activity in Rice

Rice plants were transformed with the GUS gene under control of the CaMV35S promoter, the rice GOS2 promoter, or the rice HMGP promoter. Plant transformation was as described above and six single copy (or low copy) events per construct were selected. Sixty T1 seeds per event were sown, and transgenic seedlings were picked up through visual marker selection. The integrity of the transgene was further confirmed by qPCR on the terminator. Seedling leaf, stem and root were sampled individually from nine 1 week-old plants per event (destructive sampling). Another nine transgenic plants per event were grown in the greenhouse until T2 seed harvesting, for later stage sampling. Samples included 6 week-old leaves, young inflorescences (1-2 days before flowering), and mature T2 seed. Two events of 35S-GUS transgenic rice were sown, sampled and analyzed in parallel to the lines with the GOS2 and the HMGP promoter, as reference and control. The promoter activities were determined by a standard quantitative GUS assay, results are shown in Table F.

TABLE F

Overview of promoter activity determined by quantitative GUS assay.

| Promoter | Specificity | 1 W Leaf | 1 W Root | 1 W Stem | 6 W Leaf | Inflorescence | T2 Seed |
|---|---|---|---|---|---|---|---|
| PRO0170 | constitutive | ++ | + | + | + | + | + |
| PRO0129 | constitutive | ++ | ++ | ++ | ++ | +++ | ++ |
| PRO35S | constitutive | ++++ | +++ | ++ | +++ | +++ | ++ |

The scoring was based on the mean value of each construct (6 event, 54 samples). 1 W: one week old seedlings; 6 W: six weeks old plants. The scoring system corresponds to GUS activity (U/mg total soluble protein) as follows: −: <1; +: 1-10; ++: 10-100; +++: 100-1000; ++++: >1000.

Example 12

*Arabidopsis* Plant Material, Engineering and Growth Conditions

Seeds of *Arabidopsis thaliana* Ler were obtained from the Nottingham *Arabidopsis* Stock Centre. The hub1-1 mutant has been described previously as ang4-1 (Berná et al., 1999). The plants were generally grown in vitro on germination medium (Valvekens et al., 1988). For root growth experiments, a single row of five plants was sown in square plates (BD Falcon) in vertical position in germination medium containing 10 g/L plant tissue culture agar (Lab M). The growth chamber conditions were 16-h-light/8-h-dark photoperiod with white light (cool-white neon tubes; Radium Lampenwerken), 100 $\mu EM^{-2} h^{-1}$ photosynthetically active radiation, and 20° C. Plants were grown in a soil:vermiculite (3:1; v/v) mixture under greenhouse conditions with a setting temperature between 21 and 30° C., relative humidity of 50 to 60%, and the irradiance (natural light and fluorescent lamps) between 100 and 120 $\mu E M^{-2} h^{-1}$ photosynthetically active radiation in a 16-h-light/8-h-dark regime.

To obtain overexpression lines of HUB1 (OE-HUB1) the open reading frame (including ATG and stop codon) of HUB1 (2637 bp) was amplified by Pfu polymerase and cloned into the pDONRT22I vector using the GATEWAY recombination strategy (Invitrogen) to obtain ENTRY clones. The ENTRY clone was recombined with the pK7WG2 vector (Karimi et al., Trends Plant Sci. 7, 193-195, 2002) to obtain a DESTINATION vector with the ORF under the control of a 35S promoter. This construct was introduced into *Agrobacterium tumefaciens* and subsequently Ler plants were transformed with the *Agrobacterium tumefaciens* suspension through floral dip. The T0 seeds were grown in high density on growth medium containing Kanamycin (50 µg/ml), Nystatin (50 µg/ml) and Carbenicillin (250 µg/ml) to select the transformants. These T1 transformants were transferred to soil to obtain T2 seeds.

Ler wild type, hub1-1 mutant and OE-HUB1 seeds were sterilized and plated on MS media with 1% agar. After 2 nights of vernalisation in dark at 4° C. the plates were put in growth chambers at 21° C., with a relative humidity of 50-60%, PAR 100-120 $\mu E/m^2/hr$ and 16/8 hours day/night regime (Long Day (LD) growth conditions). Short Day (CD) growth conditions comprised an 8/16 hours day/night regime.

Example 13

Analysis of *Arabidopsis* Plants

Leaf lamina length, width and area of the hub1-1 mutant, HUB1 overexpression line and Ler wild type were measured during a time course of three weeks after sowing. The juvenile leaves one and two were sampled during this time course by initially clearing the chlorophyll in 70% ethanol overnight. The cleared samples were then transferred into 100% lactic acid for preservation. The cleared leaves were mounted on a microscope slide and photographed using a an Axiom video camera (ZEISS, USA) installed on the Bino-Leica microscope and the measurements of the lamina length, width and area was performed with ImageJ 1.34 software program. For statistical analysis, pair wise comparison of the data was done with an online statistical program (Uitenbroek, D. G, Binomial. SISA. 1997. quantitativeskills.com/sisa/distributions/binomial.htm).

Determination of flowering time: the start of bolting was observed visually and is expressed in days after vernalisation.

For determination of photosynthetic pigments, 50 mg leaf samples were harvested from 25 days old in vitro grown seedlings. The samples were submerged in 2 ml of cold 80% acetone and ground with glass beads. Samples were centrifuged (5' at 4 C) and supernatant was transferred in fresh tubes and adjusted to 5 ml with 80% acetone. The pigments were extracted overnight in −20 C, centrifuged and analysed in a spectrophotometer in plastic cuvettes at 3 wave lengths (at 663, 646, and 470 nm).

Chlorophyll a content was calculated from (12.21*A663)-(2.81*A646),

Chlorophyll b content from (20.31*A646)-(5.03*A663),

Total carotenoid content from (1000*A470)-(1.82*chl a)-(85.02*chl b).

For each case, the pigment content was calculated per 50 mg fresh weight. The experiment was repeated twice and each sample was analysed in triplicate.

Microarray Analysis:

Shoot apexes of seedlings of the three lines were harvested at developmental stage 1.02 and total RNA was extracted by RNeasy (Qiagen) according to the manual. The samples were hybridized on Agilent arrays and the data were normalised. All analyses were performed on the log base 2 foreground fluorescence intensity measurements. The expression data were analyzed in two steps: 1) a "within slide" analysis aimed at removing variation associated with differential dye responses to binding as noise; and 2) a "between slide" analysis aimed at estimating the mean differences between genotypes and their standard error. For the within slide analysis, a spatial linear fixed model of the form $$\text{response} = \mu + \text{spline}(\text{intensity}) + \text{residual} \tag{1}$$

was applied, where the response variable is the $\log_2$ ratio of the foreground fluorescence intensities (M) measured at the 37971 gene spots. Within the model (1), the dye bias was represented by a cubic smoothing spline curve (spline(intensity)), as implemented in the GenStat menu for microarray data analysis. Once the adjusted $\log_2$ ratios (M') for each gene were obtained, adjusted $\log_2 R$ and $\log_2 G$ signal intensities were calculated. For the between slide analysis, a two step mixed model analysis of variance was used and performed with GenStat. Each of the 24 hybridization samples was subjected to a linear normalization model of the form (random terms underlined)

$$\text{response} = \underline{\mu + \text{array}} + \text{residual} \quad (2)$$

where the response variable represents the corrected $\log_2$ transformed Cy3 and Cy5 fluorescence intensity measurements of the 37971 gene-specific tags. Array modeling the hybridization effects of each of the 12 microarrays, were added as random terms.

In a last step, the proportion of expressed genes was estimated for which a significant part of their variation can be attributed to genotypic differences, i.e., is genetic. The residuals from the model (2) were analyzed for each of the 37971 genes separately by a mixed model of the following form $$\text{residual} = \mu + \text{dye} + \text{replicate} + \text{genotype}_{ij} + \underline{\text{array}} + \underline{\text{error}} \quad (3)$$

partitioning gene specific variation into gene specific fixed dye (Cy3 and Cy5), replicate (A and B) and genotypic effects, and random spot effects. The genotypic effect, genotype$_{ij}$, refers to the 3 genotypes Ler, hub1-1, OE-HUB1. The array term models the effects for each spot and equals the (Gene.Array) interaction effect. Random effects in the model were assumed to be independent and normally distributed with means zero and variance $\sigma_t^2$, where t=A (array) and E (error).

The linear mixed model (3) was fitted and, and a measure of variability in expression levels among the four genotypes, Wald statistics were calculated and significance was assigned to each of the six pair wise comparison between genotypes. The False Discovery Rates (FDRs) were subsequently estimated by modeling the adjusted P-values as a 2-component mixture of Uniform and Beta densities, as implemented in GenStat; default parameter settings were used to estimate $\pi_0$, the proportion of features that are truly null. Finally, a 2-fold change in genotype expression difference was imposed to further filter genes likely to have a statistically and biologically significant difference in genotype expression. BinGo analysis was performed on the data to identify the overrepresented and underrepresented biological processes affected in the different HUB1 misexpression lines (Maere et al., Bioinformatics 21, 3448-3449, 2005).

Example 14

Overexpression of HUB1 Under Control of the CaMV35S Promoter in *Arabidopsis* Results in Improved Growth Properties Seeds of HUB1 overexpressing lines (OE-HUB1) showed enhanced germination vigour compared to wild type (Ler) or hub1-1 mutant lines: Ler wild type, hub1-1 mutant and OE-HUB1 seeds were sterilized and plated on MS media with 1% agar. After 2 nights of vernalisation in dark at 4° C. the plates were put in growth chambers at 21° C., with a relative humidity of 50-60%, PAR 100-120 µE/m2/hr and 16/8 hours day/night condition. Germination was monitored daily and visible signs of germination were recorded. The growth promoting effect of HUB1 overexpression was observed as enhanced germination vigour of the transgenic seedlings compared to wild type or hub1-1 mutant. In wild type plants, the majority of the seedlings germinated two days after vernalisation (DAV) (FIG. 15). For 50% of OE-HUB1 seedlings germination was detected already on the first day after vernalisation and the other 50% germinated on the second day. In the hub1-1 mutant germination was delayed by one day and for 50% of the seedlings germination was observed only on the third day. To analyse the underlying mechanisms of the enhanced germination vigour cell areas of Ler and OE-HUB1 lines were measured during the juvenile leaf growth. In the beginning of the growth OE-HUB1 indeed shows an enhancement of cell growth which is however levelled out by the time leaves reach their mature size (FIG. 16). Thus the positive HUB1 effect on *Arabidopsis* growth takes place early in development.

Furthermore, it was investigated whether the hub1-1 mutation would lead to changes in silique and seed development. For the analysis fully grown green siliques (4 to 8 days after fertilization) were harvested and scanned for analysis or photographed for images. The ImageJ software program (Image Processing and Analysis in Java, developed at the Research Services Branch, National Institute of Mental Health, Bethesda, Md., USA) was used to calculate the area of the scanned siliques. The number of siliques per plant was counted from scanned whole plants.

Seeds were harvested from the dried siliques and scanned. The seed area was calculated from scans using the ImageJ program. Seed weight was determined by wrapping 200 seeds in an aluminum foil of known weight and measured. The seed yield per plant was subjected to t-test analyses. The area of hub1-1 siliques was found to be severely reduced (FIGS. 17 and 18). The hub1-1 siliques also contained fewer seeds with 50-80 unfertilized seeds, resulting in reduced total seed yield. The hub1-1 seeds were also smaller in size (FIG. 19). As a result the total seed yield of hub1-1 plants was dramatically reduced compared to Ler wild type (FIG. 20). While in hub1-1 mutant plants the silique and seed parameters were strongly affected, in the HUB1 overexpression lines no significant effects on the seed parameters were observed. This may be due to the fact that in *Arabidopsis* seed development is not dependent on cell growth or that the overexpression under control of the 35S CaMV promoter was not optimal. However, in the HUB1 overexpression lines the siliques (fruit) morphology was altered by increased area in width (FIG. 18).

Example 15

Mutagenesis of HUB1 and Functional Characterisation of the HUB1pm Mutant

The coding sequence of octamer of cysteines and histidines in the RING domain of HUB1 was mutagenised by PCR mediated site directed mutagenesis (QuickChange, Stratagene), such that Cys1 and Cys2 were changed into Ser residues (FIG. 1, panel B). The recombinant proteins were cloned as fusion proteins with His and GST epitope tags, expressed in *E. coli* and purified on affinity columns. The purified proteins were tested for histone H2B monoubiquitination and for self-ubiquitination activity in an in vitro (auto) ubiquitination assay as described by Fleury et al. (2007), see also Example 6.

The pointmutations in the RING domain reduced the autopolyubiquitination activity as indicated by reduced levels of these modifications on the western blots (FIG. 5, HA-Ab). The equal loading of GST-HUB1 is shown by GST Ab (FIG. 5, GST-Ab). These data confirmed that the RING domain was required for the autoubiquitination activity. Unexpectedly, histone H2B monoubiquitination was not affected by the point mutations (FIG. 5, HA-Ab). In addition, the presence of H2B substrate reduced the autopolyubiquitination activity suggesting that in the absence of substrate HUB1 protein may be removed through protein degradation. It is assumed that the point mutations render the protein to dominant positive by reducing the autoregulation and thereby stabilising the protein. However, in an initial test with proteasome inhibitor (MG132) treatment no accumulation of HUB1 protein was observed suggesting that it may not be an unstable protein but that the polyubiquitination may have an alternative yet to be identified regulatory function.

The RING domain is mainly involved in interaction with the E2 enzyme and it seems that the point mutations generated in this disclosure do not abolish this interaction or that a fully functional RING domain is not absolutely necessary for mediating the histone modifications. Other possible mutations of ubiquitin E3 ligases and RING domains would include targeting additional amino acids of the octamer of cysteines and histidines holding the two Zinc atoms. The possibilities include replacing one or two cysteines holding one Zn or replacing two or four cysteines holding the two Zn atoms. A more severe alteration is deletion of the whole RING domain, which would create a mutant comparable to the hub1-1 mutant. The hub1-1 phenotypes are uniquely strong as compared to the knockout alleles in Col-0 background (Fleury et al., 2007) and may suggest that the early stop codon in front of the RING domain causes the generation of a truncated protein with a dominant negative effect on the protein function. Antibodies are being generated to confirm the truncation of the HUB1 protein in hub1-1 lines. NTAP-tagged HUB1 and HUB1pm constructs were generated for Tandem Affinity Purification experiments for interactome studies. The RING domain of an ubiquitin E3 ligase usually mediates interactions with the E2 enzyme. The point mutations generated in the HUB1 RING domain however had an effect on the interactome. While the full length HUB1 was able to bind the homologous protein HUB2 the point mutations appeared to abolish this binding activity.

To further analyse the role of the RING domain in HUB1 (when functioning in protein degradation) towards plant growth regulation, the TAP tagged wild type and point mutant constructs were transformed in *Arabidopsis* plants. Western blot analysis was used for detecting the protein levels in plants and assessing the impact of proteasome inhibitor treatment on Hub1 protein levels. Usually point mutations in the RING domain generate dominant negative forms of the E3 ligases, which trap the substrates but do not mediate their ubiquitination and thus the targets are stabilized. The phenotypes of point mutant transgenic plants are expected to be milder than those of null mutants due to only a titration effect on the substrates. Molecular characterization of the point mutant protein in vitro however, suggests that HUB1 may be rather stabilized due to reduced autoregulation while no reduction in H2B monoubiquitination was observed.

Example 16

Overexpression of HUB1pm in Transgenic *Arabidopsis* Improves Plant Growth Properties The *Arabidopsis thaliana* hub1-1 mutant or wild type Ler was transformed with the HUB1 or HUB1pm coding sequence, each under control of the CaMV35S promoter, and cultivated as described above. It was unexpectedly found that overexpression of the HUB1pm mutant in Ler background had an effect on leaf width, and the increased leaf width is more prominent for HUB1pm than for HUB1 (FIG. 21A); the same effect was observed in the mutant hub1-1 background, in particular leaves 3 to 9 of the HUB1pm transformant had increased leaf width, compared to the control or the HUB1 transformant (FIG. 21B).

Example 17

Overexpression of the HUB1pm Protein Under Control of a Medium Strength Promoter Increases Seed Yield

*Oryza sativa* is transformed with the HUB1pm coding sequence operably linked to a medium strength promoter (such as the HMGP promoter) and are cultivated as described above. The plants have improved growth characteristics, comprising one or more of: increased biomas, increased germination vigour, increased early vigour, increased seed yield, increased stress tolerance.

Example 18

Circadian Clock Gene Expression is Affected by Modulated HUB1 Expression

OE-HUB1 microarray data suggested that circadian clock is impaired in HUB1 misexpression lines. Input genes, clock oscillator genes as well as output genes were detected as up regulated in the HUB1 overexpression line. To identify true HUB1 target genes, oppositely regulated genes between hub1-1 mutant and OE-HUB1 lines were recorded from the microarray experiment. Table G shows a list of 43 genes that were significantly downregulated in the hub1-1 mutant and upregulated in the OE-HUB1 line, the data are ranked according to ascending log 2 ratios between hub1-1 and OE-HUB1. From the first 43 genes oppositely regulated between the overexpression (up) and mutant (down) lines 18 were diurnally regulated and 8 of these diurnally regulated genes were part of the top 10 (Table G). Among these genes the circadian clock oscillator components such as CCA1, LHY and APRR9 were detected. In addition, expression of the F-box family protein (FKF1)/adagio 3 (ADO3) E3 ubiquitin ligase SCF complex F-box subunit and ELF4 (respectively At1g68050 and At2g40080, both clock input genes), the clock oscillator genes APRR5 (pseudo-response regulator 5, At5g24470), APRR3 (pseudo-response regulator 3, At5g60100), and TOC1 were upregulated in the hub1-1 mutant, but downregulated in the OE-HUB1 plants. Several clock output genes, including chlorophyll A-B binding proteins (such as LHCB4.3, At2g40100), were upregulated OE-HUB1 plants. Taken together these data confirm that circadian clock is impacted by HUB1 misexpression. To further confirm whether the frequency or the amplitude of the circadian clock is affected in the hub1 lines a time course experiment with QPCR analysis of clock genes was carried out. To this end, in vitro grown seedlings were used that had germinated under short day conditions, after 12 to 14 days moved to continuous light conditions. Sampling started after 24 hrs in continuous light, above-ground parts were harvested every 4 hours during a 48 hour time period. RNA was extracted using RNeasy (Qiagen) followed by a DNase treatment. cDNA was prepared with a first strand synthesis kit (Invitrogen) starting from 3 ug of total RNA. 5 µl of diluted cDNA (20 ng/ul) was used in each reaction with SYBR Green and gene specific primers. QPCR was performed in a Bio Rad iCycler using standard techniques.

The first results showed that in the hub1-1 mutant CCA1 expression was reduced in amplitude with a shift in the wave.

TABLE G

Genes oppositely regulated between hub1-1 with negative log2 values and OE-HUB1 (with positive log2 values).

| name | hub1-1 | Ler | OEHUB1 | AGI code | Diurnal |
|---|---|---|---|---|---|
| CCA1 | −1.9 | 1.5 | 4.6 | At2g46830 | D |
| LHY | −1.9 | 0.2 | 4.0 | At1g01060 | D |
| expressed prot. | −1.3 | 0.8 | 4.0 | At3g12320 | D |
|  | −4.4 | 0.1 | 0.5 | At2g18880 |  |
| hypothetical prot. | −4.2 | −1.6 | 0.8 | At3g09450 |  |
| APRR9 | −3.5 | −1.9 | 0.9 | At2g46790 | D |
| MYB TR F | −1.4 | 0.0 | 2.8 | At3g09600 | D |
| galactinol synth. | −1.1 | 0.5 | 2.9 | At2g47180 | D |
| CIPK20 | −0.5 | 3.5 | 3.5 | At5g45820 | D |
| beta-carotenoid hydroxylase | −0.9 | 1.2 | 3.1 | At5g52570 | D |
| RCC1 | −0.7 | 1.4 | 2.9 | At3g53830 |  |
| F-box | −2.8 | 0.6 | 0.7 | At5g60610 |  |
| LEA domain | −2.6 | 0.5 | 0.9 | At4g13560 |  |
| LHCB2 | −2.7 | −0.7 | 0.7 | At2g05100 | D |
| glycerophosphoryl diester | −1.7 | −0.2 | 1.2 | At5g08030 |  |
| oxidoreductase | −0.4 | 1.2 | 2.5 | At2g36690 |  |
| expressed prot. | −2.8 | 0.2 | 0.0 | At1g62190 |  |
| DREB1C/CBF2 | −1.2 | 0.5 | 1.6 | At4g25470 |  |
| leucine-rich repeat | −0.6 | 1.5 | 1.9 | At1g51800 |  |
| Zn finger B-box | −1.7 | −1.7 | 0.8 | At3g21150 |  |
| transcription factor | −2.2 | −1.9 | 0.3 | At4g18650 | D |
| expressed prot. | −1.4 | 1.3 | 1.1 | At5g45830 |  |
| transcription factor | −0.1 | 2.3 | 2.3 | At2g35310 |  |
| glycocyl transferase | −1.6 | 0.7 | 0.8 | At2g13680 |  |
| VSP1 | −0.9 | 1.2 | 1.5 | At5g24780 | D |
| aminotransferase | −1.8 | −0.4 | 0.6 | At2g24850 |  |
| protein | −2.2 | 0.0 | 0.1 | AV786179 |  |
| cytochrome P450 | −0.1 | 1.8 | 2.1 | At2g29090 | D |
| TIR class protein | −1.5 | −0.2 | 0.7 | At1g65390 |  |
| hydroxyproline rich prot | −2.2 | −0.8 | 0.0 | At1g11070 |  |
| WRKY | −0.2 | 0.7 | 2.0 | At1g80840 |  |
| SUC5 | −0.5 | 0.9 | 1.7 | At1g71890 |  |
| transcription factor | −1.1 | 0.5 | 1.1 | At4g31680 |  |
| jacalin lectin prot | −1.4 | 0.6 | 0.8 | At5g35940 |  |
| ABC transporter | −0.1 | 1.3 | 2.0 | At1g15520 |  |
| expressed prot. | −1.8 | −0.4 | 0.3 | At3g28270 | D |
| DREB2A like | −0.3 | 0.3 | 1.8 | At1g75490 |  |
| NAM family | −1.7 | −1.5 | 0.3 | At1g69490 | D |
| DOF zn finger protein | 0.0 | 0.2 | 2.0 | At1g69570 | D |
| expressed prot. | −0.5 | 1.5 | 1.5 | At3g17890 |  |
| zinc finger B-box | −1.7 | −1.5 | 0.3 | At3g21890 | D |
| DOF zn finger protein | −0.2 | 0.6 | 1.8 | At5g62430 | D |
| unknown | 0.0 | 1.9 | 2.0 | CHR3: 006127463-006127522 |  |
| SAUR/AC1 | −1.9 | −0.7 | 0.1 | At4g38850 | D |

Genes are ordered with ascending log2 ratios between hub1-1 and OE-HUB1 with a cut off log2 ratio at −1.99.
D; diurnally regulated. Log2; expression values.

Example 19

Downstream Pathways of Circadian Clock are Affected by Modulated Expression of HUB1

Output genes of circadian clock include regulators of photosynthetic capacity and plastid development. To elucidate the light dependent phenotypes hub1-1 mutant, Ler wild type and HUB1 overexpression plants were grown in three different light conditions; long day (LD), short day (SD) and continuous light (CL) for phenotypic characterisation (FIG. 6). The hub1-1 mutant grown under short day light conditions clearly had a pale colour. In long day conditions hub1-1 growth phenotype was mildest and mainly as described in Fleury et al., (2007). In LD and CL conditions hub1-1 seedlings showed only occasionally a lack of pigments.

To confirm that hub1-1 mutant plants had reduced photosynthetic capacity the content of photosynthetic pigments namely, chlorophyll a and b and total carotenoid contents was analysed in plants grown under the three light regimes. In SD all pigments were reduced (FIG. 7). The pale leaf colouration and reduced pigment content predicts defects in plastid structures and this hypothesis is supported by the transcriptome data. This was confirmed upon investigating the subcellular characteristics underlying the light phenotypes by Transmission Electron Microscopy. The first images by TEM show altered thylacoid membrane structures for hub1-1 mutant (FIG. 8). The total amount of membranes and grana were reduced and there were more plastoglobuli present in the stroma.

Example 20

Light Dependent Phenotypes of HUB1-1 are Enhanced in Short Day Conditions

In addition to the reduced photosynthetic capacity, circadian clock regulated phenotypes in hub1-1 include reduced hypocotyl length, reduced leaf growth and early flowering time. We compared these clock related phenotypes in the HUB1 misexpression lines (OE and mutant) in comparison to wild type Ler. Plants were grown in short day conditions and their hypocotyl lengths were measured after 21 days of growth. Hub1-1 mutant hypocotyl lengths were reduced (FIG. 9). In dark grown seedlings no differences in hypocotyl length were observed.

It has also been suggested that impaired plastid development may affect leaf morphology. To compare the growth phenotypes in the three conditions the leaf area was measured of the 21 days old in vitro grown seedlings. While the growth of cotyledons of the hub1-1 mutant is not affected, the expansion growth of the true leaves is severely repressed in all conditions (FIGS. 6, 10 and 11).

Furthermore, new morphological effects were observed in the hub1-1 mutant grown under short day conditions. From the leaf three and four onwards some leaves only developed as spike like structures or had their mid vein protruding out from the abaxial side of a narrow leaf (FIG. 12). In addition to the spike-like structures, hub1-1 mutants showed altered leaf morphologies such as reduced growth, narrow leaf lamina and altered venation pattern. Also altered flower morphologies have been observed. Flower structures from hub1-1 mutant plants revealed that flower meristems and organs were missing and/or misplaced (FIG. 13).

Furthermore, hub1-1 mutant plants flower early in SD conditions as well as in both other growth conditions, based on the start of bolting.

Example 21

Altered Expression of Developmental Genes Correlates with HUB1-1 Phenotypes hub1-1 mutant plants have severe leaf phenotypes with reduced growth, altered venation patterns and occasionally appearing protruding mid veins or spike-like true leaves. The microarray data of HUB1 misexpression lines has shown alterations of a number of developmental genes such as the KNAT, WUS, AP2, CLAVATA genes (Table H). FIG. 14 shows expression patterns of the developmental genes identified in HUB1 microarrays according to Genevestigator.

TABLE H developmental genes differentially expressed in hub1-1 and Ler wild type or OE-HUB1 lines.

| NAME | AGI code | hub1/ler log2 ratio | hub1/OE17 x log2 ratio |
|---|---|---|---|
| MYB60 | At1g08810.1 | −1.65 | −1.62 |
| CLV1 like | At1g08590.1 | −1.46 | −1.18 |

TABLE H-continued developmental genes differentially expressed in hub1-1 and Ler wild type or OE-HUB1 lines.

| NAME | AGI code | hub1/ler log2 ratio | hub1/OE17 x log2 ratio |
|---|---|---|---|
| MYB | At3g09600.1 | −1.39 | −4.20 |
| MYB | At2g40260.1 | −1.34 | −1.40 |
| MYB56 | At5g17800.1 | −1.32 | −1.37 |
| MYB | At1g18330.1 | −1.10 | −1.41 |
| WUS like | At3g11260.1 | −0.93 | |
| AP2 like | At5g67180.1 | −0.89 | −0.68 |
| COL | At1g07050.1 | −0.84 | 4.49 |
| MADS | At1g26310.1 | −0.84 | −0.73 |
| MYB | At5g44190.1 | −0.74 | −1.36 |
| ARR7 | At1g19050.1 | −0.63 | −0.73 |
| WUS like | At3g18010.1 | −0.54 | −0.73 |
| MYB | At1g01520.1 | −0.49 | −2.04 |
| BEL1 | At5g41410.1 | −0.42 | 0.42 |
| TCP3 | At1g53230.1 | −0.38 | |
| AP2 | At4g36920.1 | −0.33 | |
| CLV2 | At1g65380.1 | −0.29 | −0.39 |
| CLV1 like | At1g27190.1 | −0.27 | −0.22 |
| ANT | At4g37750.1 | 0.33 | 0.32 |
| AP2 like | At5g60120.1 | 0.36 | 0.44 |
| LBD6 | At1g65620.1 | 0.37 | 0.29 |
| WER | At5g14750.1 | 0.39 | 0.53 |
| WUS like | At1g46480.1 | 0.53 | 0.73 |
| KNAT7 | At1g62990.1 | 0.62 | 0.63 |
| LFY | At5g61850.1 | 0.69 | 0.41 |
| KNAT1 | At4g08150.1 | 0.88 | 0.57 |
| AP2 like | At3g54990.1 | 0.95 | 1.02 |
| CCA1 | At5g17300.1 | 1.56 | −0.73 |
| jmjC | At3g20810.1 | 2.07 | 6.66 |
| MADS | At5g40220.1 | 4.69 | 4.39 |
| CUC2 like | At5g14490.1 | 5.88 | 6.31 |
| MYB15 | At3g23250.1 | | −1.50 |
| KNAT4 | At5g11060.1 | | 0.57 |
| DRM1 | At1g28330.1 | | 4.27 |
| DRM1 | At1g28330.3 | | 5.29 |

Missing values were not significant (p). Genes were sorted according ascending ratio btw hub1-1 and Ler wild type.

Example 22

Modulation of Biological Processes in HUB1-1 Compared to Ler Wild Type Plants and to HUB1 OE A BiNGO analysis (a tool to determine which Gene Ontology (GO) terms are significantly overrepresented in a set of genes) was performed on the micro array data (Example 13) to identify biological processes that were influenced by HUB1 misexpression. Tables I1 and I2 show a list of genes that were differentially expressed in hub1-1 compared to Ler WT plants:

TABLE I1 genes downregulated in hub1-1 vs Ler (SEQ ID NO: 244 to SEQ ID NO: 835)

| | | | | | |
|---|---|---|---|---|---|
| AT1G01010 | AT1G55670 | AT2G26760 | AT3G19820 | AT4G18480 | AT5G24400 |
| AT1G02065 | AT1G56200 | AT2G26760 | AT3G20070 | AT4G18960 | AT5G24400 |
| AT1G02800 | AT1G56200 | AT2G27380 | AT3G20070 | AT4G19350 | AT5G24400 |
| AT1G03120 | AT1G56200 | AT2G27960 | AT3G20070 | AT4G19350 | AT5G24470 |
| AT1G03130 | AT1G57770 | AT2G27960 | AT3G20440 | AT4G19350 | AT5G24470 |
| AT1G04110 | AT1G58290 | AT2G27960 | AT3G20440 | AT4G19560 | AT5G24470 |
| AT1G05190 | AT1G58290 | AT2G27970 | AT3G20440 | AT4G19560 | AT5G24470 |
| AT1G05190 | AT1G59940 | AT2G28000 | AT3G20780 | AT4G19560 | AT5G24470 |
| AT1G05190 | AT1G59940 | AT2G29090 | AT3G21640 | AT4G20050 | AT5G26742 |
| AT1G06570 | AT1G60600 | AT2G29090 | AT3G22200 | AT4G20060 | AT5G26742 |
| AT1G06820 | AT1G63260 | AT2G29090 | AT3G22780 | AT4G20060 | AT5G26742 |
| AT1G07370 | AT1G63970 | AT2G30950 | AT3G22880 | AT4G20060 | AT5G27720 |
| AT1G07370 | AT1G63970 | AT2G30950 | AT3G24560 | AT4G20910 | AT5G27720 |
| AT1G07370 | AT1G63970 | AT2G32250 | AT3G24560 | AT4G20910 | AT5G27720 |
| AT1G08090 | AT1G65470 | AT2G32250 | AT3G24560 | AT4G21270 | AT5G35220 |

TABLE I1-continued genes downregulated in hub1-1 vs Ler (SEQ ID NO: 244 to SEQ ID NO: 835)

| | | | | | |
|---|---|---|---|---|---|
| AT1G08520 | AT1G66330 | AT2G32590 | AT3G24730 | AT4G24150 | AT5G35520 |
| AT1G08520 | AT1G66650 | AT2G33480 | AT3G25980 | AT4G25080 | AT5G35630 |
| AT1G08840 | AT1G67440 | AT2G33810 | AT3G25980 | AT4G25080 | AT5G37630 |
| AT1G08840 | AT1G67440 | AT2G33810 | AT3G25980 | AT4G25700 | AT5G37630 |
| AT1G08840 | AT1G67440 | AT2G34420 | AT3G27920 | AT4G26500 | AT5G37630 |
| AT1G09000 | AT1G67740 | AT2G34420 | AT3G29290 | AT4G26500 | AT5G37630 |
| AT1G10470 | AT1G68050 | AT2G34430 | AT3G29290 | AT4G26500 | AT5G37780 |
| AT1G10470 | AT1G68050 | AT2G34430 | AT3G29290 | AT4G27700 | AT5G37780 |
| AT1G10510 | AT1G68480 | AT2G34650 | AT3G33520 | AT4G28190 | AT5G37890 |
| AT1G10510 | AT1G68900 | AT2G34650 | AT3G33520 | AT4G28190 | AT5G39820 |
| AT1G10510 | AT1G68900 | AT2G34650 | AT3G44560 | AT4G28210 | AT5G40280 |
| AT1G11870 | AT1G69040 | AT2G37680 | AT3G44880 | AT4G28210 | AT5G40600 |
| AT1G12770 | AT1G69040 | AT2G37680 | AT3G44880 | AT4G28210 | AT5G40600 |
| AT1G12770 | AT1G69040 | AT2G37860 | AT3G47500 | AT4G28660 | AT5G40600 |
| AT1G12770 | AT1G69440 | AT2G37920 | AT3G47500 | AT4G28980 | AT5G41480 |
| AT1G13690 | AT1G69440 | AT2G37920 | AT3G48110 | AT4G29830 | AT5G41480 |
| AT1G13870 | AT1G70210 | AT2G37920 | AT3G48110 | AT4G29830 | AT5G41480 |
| AT1G14150 | AT1G70210 | AT2G38280 | AT3G48190 | AT4G30950 | AT5G42190 |
| AT1G15570 | AT1G70210 | AT2G38280 | AT3G48470 | AT4G30950 | AT5G42190 |
| AT1G15570 | AT1G71230 | AT2G38280 | AT3G48470 | AT4G31500 | AT5G42190 |
| AT1G15570 | AT1G71230 | AT2G39470 | AT3G48470 | AT4G31500 | AT5G43080 |
| AT1G15820 | AT1G71230 | AT2G40760 | AT3G50210 | AT4G31500 | AT5G43080 |
| AT1G18450 | AT1G71230 | AT2G41720 | AT3G50790 | AT4G32810 | AT5G43080 |
| AT1G19050 | AT1G71230 | AT2G41720 | AT3G50790 | AT4G33790 | AT5G45930 |
| AT1G20610 | AT1G71230 | AT2G41720 | AT3G50790 | AT4G34620 | AT5G45930 |
| AT1G20610 | AT1G71440 | AT2G41980 | AT3G51160 | AT4G34620 | AT5G47110 |
| AT1G20610 | AT1G71440 | AT2G43010 | AT3G52430 | AT4G34620 | AT5G47110 |
| AT1G20930 | AT1G71440 | AT2G43010 | AT3G53130 | AT4G35900 | AT5G48150 |
| AT1G20930 | AT1G73590 | AT2G43280 | AT3G54420 | AT4G35900 | AT5G48150 |
| AT1G20930 | AT1G73590 | AT2G43280 | AT3G54420 | AT4G36920 | AT5G48150 |
| AT1G21970 | AT1G73590 | AT2G45330 | AT3G54420 | AT4G36920 | AT5G48150 |
| AT1G21970 | AT1G73590 | AT2G45330 | AT3G54720 | AT4G36920 | AT5G48150 |
| AT1G21970 | AT1G73590 | AT2G45330 | AT3G54720 | AT4G37000 | AT5G48630 |
| AT1G22770 | AT1G74470 | AT2G45480 | AT3G54720 | AT4G37230 | AT5G48630 |
| AT1G22770 | AT1G74470 | AT2G46340 | AT3G54720 | AT4G37230 | AT5G48630 |
| AT1G22920 | AT1G75350 | AT2G46340 | AT3G54720 | AT4G37580 | AT5G48820 |
| AT1G22920 | AT1G75350 | AT2G46340 | AT3G54720 | AT4G37580 | AT5G48820 |
| AT1G22920 | AT1G75350 | AT2G46340 | AT3G55330 | AT4G37580 | AT5G48820 |
| AT1G22920 | AT1G76570 | AT2G46340 | AT3G58780 | AT4G37580 | AT5G49030 |
| AT1G22920 | AT1G77080 | AT2G46340 | AT3G59400 | AT4G37580 | AT5G49555 |
| AT1G22920 | AT1G77080 | AT2G46820 | AT3G59400 | AT4G37740 | AT5G49880 |
| AT1G23080 | AT1G77850 | AT2G48120 | AT3G60370 | AT4G39100 | AT5G49880 |
| AT1G23080 | AT1G78630 | AT2G48120 | AT3G60830 | AT4G39100 | AT5G49880 |
| AT1G23080 | AT1G78630 | AT3G02380 | AT3G60830 | AT4G39100 | AT5G50280 |
| AT1G24260 | AT1G78630 | AT3G02380 | AT3G60830 | AT4G39100 | AT5G50280 |
| AT1G24340 | AT1G80080 | AT3G02660 | AT3G61470 | AT4G39100 | AT5G50280 |
| AT1G24340 | AT1G80370 | AT3G02660 | AT3G61470 | AT4G39620 | AT5G52570 |
| AT1G24340 | AT1G80370 | AT3G02660 | AT3G61780 | AT4G39620 | AT5G53090 |
| AT1G25580 | AT1G80370 | AT3G02780 | AT3G61780 | AT4G39620 | AT5G53660 |
| AT1G26310 | AT2G01420 | AT3G02780 | AT3G61780 | AT5G01530 | AT5G57030 |
| AT1G26310 | AT2G04160 | AT3G03450 | AT4G00180 | AT5G02250 | AT5G57030 |
| AT1G29410 | AT2G04842 | AT3G03450 | AT4G01710 | AT5G02250 | AT5G57030 |
| AT1G30610 | AT2G04842 | AT3G04630 | AT4G02560 | AT5G02250 | AT5G57050 |
| AT1G30610 | AT2G04842 | AT3G06350 | AT4G02560 | AT5G04560 | AT5G57050 |
| AT1G30610 | AT2G05620 | AT3G06350 | AT4G02770 | AT5G04560 | AT5G60540 |
| AT1G32200 | AT2G13680 | AT3G06350 | AT4G03270 | AT5G04560 | AT5G60540 |
| AT1G32200 | AT2G16500 | AT3G06430 | AT4G03270 | AT5G06240 | AT5G60540 |
| AT1G32200 | AT2G16500 | AT3G06430 | AT4G03270 | AT5G06240 | AT5G61510 |
| AT1G33060 | AT2G16500 | AT3G06430 | AT4G03280 | AT5G06240 | AT5G62430 |
| AT1G33280 | AT2G17620 | AT3G07390 | AT4G04350 | AT5G07280 | AT5G62430 |
| AT1G42970 | AT2G17620 | AT3G07430 | AT4G04350 | AT5G08170 | AT5G63050 |
| AT1G43710 | AT2G17620 | AT3G07430 | AT4G04350 | AT5G08170 | AT5G63050 |
| AT1G43710 | AT2G18020 | AT3G07430 | AT4G04900 | AT5G08170 | AT5G63050 |
| AT1G43710 | AT2G18020 | AT3G07500 | AT4G10180 | AT5G10140 | AT5G63790 |
| AT1G44110 | AT2G18020 | AT3G07500 | AT4G10180 | AT5G10140 | AT5G64050 |
| AT1G44110 | AT2G20000 | AT3G10390 | AT4G10180 | AT5G10330 | AT5G64520 |
| AT1G44110 | AT2G20000 | AT3G10390 | AT4G10180 | AT5G10330 | AT5G65060 |
| AT1G44446 | AT2G20000 | AT3G10670 | AT4G10180 | AT5G10330 | AT5G65060 |
| AT1G44446 | AT2G20000 | AT3G10670 | AT4G10180 | AT5G10360 | AT5G65070 |
| AT1G45474 | AT2G20000 | AT3G10670 | AT4G10350 | AT5G10360 | AT5G65070 |
| AT1G45474 | AT2G20000 | AT3G11670 | AT4G12550 | AT5G10360 | AT5G65080 |
| AT1G47530 | AT2G21710 | AT3G11670 | AT4G12980 | AT5G10480 | AT5G65080 |
| AT1G47530 | AT2G21710 | AT3G13960 | AT4G13560 | AT5G10480 | AT5G65930 |
| AT1G48270 | AT2G21710 | AT3G14110 | AT4G13560 | AT5G12990 | AT5G66055 |
| AT1G48270 | AT2G22840 | AT3G14110 | AT4G13560 | AT5G16715 | AT5G66055 |
| AT1G48270 | AT2G22870 | AT3G15030 | AT4G15090 | AT5G16715 | AT5G66055 |
| AT1G48270 | AT2G22870 | AT3G15270 | AT4G15090 | AT5G16715 | AT5G66570 |
| AT1G48380 | AT2G22870 | AT3G15270 | AT4G15510 | AT5G17710 | AT5G66570 |

TABLE I1-continued genes downregulated in hub1-1 vs Ler (SEQ ID NO: 244 to SEQ ID NO: 835)

| | | | | | |
|---|---|---|---|---|---|
| AT1G49510 | AT2G23430 | AT3G16290 | AT4G15560 | AT5G17710 | AT5G67030 |
| AT1G49510 | AT2G23430 | AT3G16290 | AT4G15560 | AT5G17710 | AT5G67180 |
| AT1G49510 | AT2G23430 | AT3G16290 | AT4G16110 | AT5G18700 | AT5G67260 |
| AT1G50250 | AT2G23430 | AT3G18110 | AT4G16250 | AT5G18700 | AT5G67260 |
| AT1G50250 | AT2G25660 | AT3G18110 | AT4G16250 | AT5G18700 | AT5G67260 |
| AT1G51190 | AT2G25660 | AT3G18110 | AT4G16280 | AT5G22290 | AT5G67570 |
| AT1G52230 | AT2G25660 | AT3G18390 | AT4G16280 | AT5G22370 | AT5G67570 |
| AT1G52890 | AT2G25840 | AT3G18390 | AT4G16750 | AT5G22370 | AT5G67570 |
| AT1G53230 | AT2G26760 | AT3G18390 | AT4G18480 | AT5G22370 | |

The genes in Table I1 are involved in photosynthesis (Gene Ontology (GO) ID nr 15979), regulation of photosynthesis, light reaction (GO ID nr 42548), chlorophyll biosynthesis (GO ID nr 15995), chlorophyll metabolism (GO ID nr 15994), carotenoid biosynthesis (GO ID nr 16117), response to red or far red light (GO ID nr 9639), photosynthesis, light harvesting (GO ID nr 9765), photomorphogenesis (GO ID nr 9640), regulation of development (GO ID nr 50793), seed development (GO ID nr 48316), development (GO ID nr 7275), cell cycle (GO ID nr 7049), regulation of cell cycle (GO ID nr 51726).

TABLE I2 genes upregulated in hub1-1 vs Ler (SEQ ID NO: 836 to SEQ ID NO: 961)

| | | | | | |
|---|---|---|---|---|---|
| AT1G09570 | AT1G70140 | AT2G25930 | AT3G46550 | AT4G32880 | AT5G20520 |
| AT1G12840 | AT1G70140 | AT2G25930 | AT3G54010 | AT4G32880 | AT5G20730 |
| AT1G12840 | AT1G70710 | AT2G26710 | AT3G54010 | AT4G34490 | AT5G25810 |
| AT1G13180 | AT1G70710 | AT2G26890 | AT3G54220 | AT4G34490 | AT5G25810 |
| AT1G13180 | AT1G70940 | AT2G34710 | AT3G54920 | AT4G36380 | AT5G26751 |
| AT1G13980 | AT1G72560 | AT2G34710 | AT3G54920 | AT4G36380 | AT5G39510 |
| AT1G13980 | AT1G75080 | AT2G34710 | AT3G61460 | AT4G39400 | AT5G49720 |
| AT1G13980 | AT1G75750 | AT2G38120 | AT4G02980 | AT4G39400 | AT5G49720 |
| AT1G17060 | AT1G75750 | AT2G46920 | AT4G02980 | AT4G39400 | AT5G52240 |
| AT1G17060 | AT1G75750 | AT3G05840 | AT4G12420 | AT4G40060 | AT5G52240 |
| AT1G19350 | AT1G75780 | AT3G13870 | AT4G12420 | AT4G40060 | AT5G53950 |
| AT1G19850 | AT1G75780 | AT3G13870 | AT4G18710 | AT5G16490 | AT5G53950 |
| AT1G36160 | AT1G76420 | AT3G15170 | AT4G18710 | AT5G16490 | AT5G62310 |
| AT1G49040 | AT2G06850 | AT3G15170 | AT4G18710 | AT5G18580 | AT5G62310 |
| AT1G49040 | AT2G06850 | AT3G15170 | AT4G23640 | AT5G18580 | AT5G64630 |
| AT1G56010 | AT2G18790 | AT3G18730 | AT4G23640 | AT5G19280 | AT5G66680 |
| AT1G56010 | AT2G20370 | AT3G23050 | AT4G30610 | AT5G20350 | AT5G66680 |
| AT1G62360 | AT2G20370 | AT3G46550 | AT4G32880 | AT5G20350 | |

The genes in Table I2 are involved in regulation of cell size (GO ID nr 8361), longitudinal axis specification (GO ID nr 9942), primary shoot apical meristem specification (GO ID nr 10072), cell morphogenesis (GO ID nr 7148), meristem organization (GO ID nr 9933, gravitropism (GO ID nr 9630), response to brassinosteroid stimulus (GO ID nr 9741).

Tables I3 and I4 show a list of genes that were differentially expressed in hub1-1 compared to HUB1 overexpressing plants (HUB1 OE):

TABLE I3 genes down in hub1-1 vs HUB OE SEQ ID NO: 962 to SEQ ID NO: 1023

| | | | | | |
|---|---|---|---|---|---|
| AT1G07790 | AT1G75600 | AT2G46830 | AT3G46030 | AT5G10400 | AT5G59870 |
| AT1G07790 | AT2G21660 | AT2G46830 | AT3G46320 | AT5G10400 | AT5G60100 |
| AT1G09200 | AT2G21660 | AT3G09480 | AT3G46320 | AT5G12910 | AT5G60100 |
| AT1G09200 | AT2G28720 | AT3G09480 | AT3G46640 | AT5G12910 | AT5G61380 |
| AT1G22770 | AT2G28720 | AT3G20670 | AT3G46640 | AT5G22880 | AT5G61380 |
| AT1G22770 | AT2G37470 | AT3G20670 | AT3G54560 | AT5G22880 | AT5G65360 |
| AT1G28330 | AT2G37470 | AT3G27360 | AT3G54560 | AT5G24470 | AT5G65360 |
| AT1G28330 | AT2G40080 | AT3G27360 | AT5G02560 | AT5G24470 | |
| AT1G51060 | AT2G40080 | AT3G45980 | AT5G02560 | AT5G27670 | |
| AT1G51060 | AT2G46790 | AT3G45980 | AT5G09230 | AT5G27670 | |
| AT1G75600 | AT2G46790 | AT3G46030 | AT5G09230 | AT5G59870 | |

The genes in Table I3 are involved in chromatin assembly (GO ID nr 31497), circadian rhythm (GO ID nr 7623).

TABLE I4 genes up in hub1-1 vs HUB OE (SEQ ID NO: 1024 to SEQ ID NO: 1045)

| AT1G04550 | AT1G56010 | AT2G34710 | AT4G08150 | AT4G37650 | AT5G53950 |
|---|---|---|---|---|---|
| AT1G13980 | AT1G56010 | AT3G54220 | AT4G24220 | AT5G53950 | AT5G63090 |
| AT1G51190 | AT2G34710 | | | | |

The genes in Table I4 are involved in pattern specification (GO ID nr 7389), primary shoot apical meristem specification (GO ID nr 10072).

From these data it can clearly be concluded that the circadian clock is under control of HUB1.

Example 23

Interactome of HUB1

First Experiment:

The role of HUB1 in histone H2B monoubiquitination suggested that HUB1 is a functional homolog of Bre1 E3 ligase. To identify HUB1 interacting proteins Tandem Affinity Purification (TAP) technology has been employed, which allows fast purification of protein complexes in their native conditions and which is based on the fusion of TAP-tags in the protein of interest (Puig et al., Methods. 24(3):218-29, 2001).

Because the RING proteins have their functionally important domain at the C-terminus, an N-terminal fusion was prepared instead of the traditional C-terminal fusion by cloning both full length and the point mutant form of HUB1 (HUB1pm, HUB1fl). The Arabidopsis cell cultures were transformed with the two constructs and cultivated on 10 liter scale, harvested and purified by TAP (Van Leene et al., Mol. Cell. Proteomics 6, 1226-38, 2007). The protein extracts were separated on 1-D SDS-PAGE gels and isolated from gel for protein identification by mass spectrometry (Laukens et al., Proteomics. 4, 720-7, 2004, Van Leene et al., 2007). Two cut offs were used resulting in "confirmed" and "to be confirmed" candidate interactor lists (Table I).

TABLE J

All confirmed and a selection of to be confirmed TAP identified HUB1 interactors. Confirmed

| Confirmed | AGI code | To be confirmed | AGI code |
|---|---|---|---|
| GCN5 | At5g11340 | SEUSS | At1g43850 |
| HUB1 | At2g44950 | SPT16 | At4g10710 |
| HUB2 | At1g55250 | NOP56 | At1g56110 |
| KH domain protein | At1g51580 | MYB | At1g58220 |
| Spen like protein | At1g27750 | FIBRILLARIN2 | At4g25630 |
| | | Ulp1 protease | At1g34610 |
| | | Ulp1 protease | At3g09170 |
| | | PhyD | At4g16250 |
| | | ubiq protease | At5g22035 |
| | | U-BOX | At5g65920 |
| | | zinc finger | At1g18660 |
| | | BRCT | At4g02110 |
| | | SCL11 | At5g59460 |

In the data set of confirmed interactors TAP HUB1 and HUB2 were present, confining the dimer formation between the homologues. In addition, the acetyltransferase GCN5, RNA binding proteins and a KH domain protein were identified as HUB1 interacting proteins. Most of these proteins are known to be localized in nucleus or nucleoli. GFP constructs of HUB1 have also been localized to nucleus (Liu et al., 2007). When HUB1pm was used for TAP purification no HUB2 could be identified as an interacting protein. These data suggest that a functional RING domain is required for HUB1 and HUB2 dimerization. A selection of the proteins that interacted only once in the TAP purification experiments is listed in table as "to be confirmed".

GCN5 is a histone acetylation enzyme involved in stress response, defense, signal transduction, transcription, metabolism, transport and in flower development where it affects two key genes such as WUSCHEL (WUS) and AGAMOUS (AG). NOP56 is required in ribosome biogenesis in yeast. Myb is a DNA binding protein with transcription factor activity involved in response to abscisic acid, jasmonic acid and salicylic acid stimuli. Fibrillarin 2 is an RNA methyltransferase and a potential substrate of AtPRMT1a and AtPRMT1b, two protein methyltransferases involved in mH4K3 among other post-translational modifications. Direct interactions with HUB1 were also shown for SEUSS and a spen-like nucleid acid binding protein. A number of the confirmed and to be confirmed interactors were tested by a Yeast two Hybrid assay to verify whether they directly interact with HUB1. Direct interaction with HUB1 was shown for HUB2, SEUSS and Spen-like proteins. Other confirmed interactors may require intermediating proteins for the interaction with HUB1.

Second Experiment:

Instead of using the original TAP tag, the optimised GS-TAP tag, developed by Van Leene et al. (Trends in Plant Science 13, 517-520, 2008), was N-terminally fused to the various bait proteins (see Table J). Constructs were transformed into Arabidopsis thaliana protoplast cells and expression of the fusion proteins was confirmed by Western analysis. Tagged proteins were produced in 5 liter scale cell cultures, extracted and the protein complexes were purified using the Tandem Affinity Purification protocol described by Van Leene et al. (2008). Bound complexes were eluted, precipitated and subjected to SDS-PAGE. Coomassie stained protein bands were extracted, trypsin digested and analysed by MALDI-TOF-TOF Mass Spectrometry.

For each experiment two independent purifications (a & b) from the same cell culture have been done and, in the case of HUB1, two different purifications have been performed in order to have a stronger support for its interaction network. The results of the different TAP purifications are listed in Table J. These data indicate the presence of a complex comprising HUB1, HUB2, SL and KH. Indeed all the TAP assays done using HUB1, HUB2 and SL as baits enabled to identify these three proteins together with KH. In addition, the results of HUB1 TAP were strengthened by purification with two different TAP tags.

TABLE K

List of proteins retrieved by TAP purification with using fusions with the GS-TAP tag.

| Bait | Prey Name | AGI Code | Expectance |
|---|---|---|---|
| HUB1 (a) | HUB1 | AT2G44950 | 2.10E−19 |
|  | HUB2 | AT1G55250 | 1.00E−20 |
| HUB1 (b) | HUB1 | AT2G44950 | 6.50E−29 |
|  | HUB2 | AT1G55250 | 5.20E−22 |
|  | KH | AT1G51580 | 1.60E−08 |
| HUB1 (a') | HUB1 | AT2G44950 | 2.10E−09 |
|  | HUB2 | AT1G55250 | 1.00E−19 |
|  | SL | AT1G27750 | 6.50E−16 |
|  | KH | AT1G51580 | 2.10E−09 |
| HUB1 (b') | HUB1 | AT2G44950 | 6.50E−16 |
|  | HUB2 | AT1G55250 | 1.60E−11 |
|  | SL | AT1G27750 | 0.024 |
|  | KH | AT1G51580 | 3.30E−09 |
|  | K3K7 | AT5G50990 | / |
| HUB2 (a) | HUB2 | AT1G55250 | 3.30E−99 |
|  | HUB1 | AT2G44950 | 8.20E−85 |
|  | SL | AT1G27750 | 0.00097 |
|  | KH | AT1G51580 | 1.30E−08 |
| HUB2 (b) | HUB2 | AT1G55250 | 3.30E−99 |
|  | HUB1 | AT2G44950 | 4.10E−68 |
|  | SL | AT1G27750 | 1.00E−24 |
|  | KH | AT1G51580 | 1.60E−09 |
| SL (a) | SL | AT1G27750 | 8.20E−07 |
|  | HUB1 | AT2G44950 | 0.0032 |
|  | HUB2 | AT1G55250 | 0.005 |
|  | KH | AT1G51580 | 0.00054 |
| SL (b) | SL | AT1G27750 | 3.30E−09 |
|  | HUB1 | AT2G44950 | 0.0016 |
|  | HUB2 | AT1G55250 | 0.0072 |
|  | KH | AT1G51580 | 2.60E−12 |
| SEUSS (a) | SEUSS | At1g43850 | 6.50E−38 |
|  | LUG/RON2 | At4G32551 | 1.30E−23 |
|  | LUH | At2G32700 | 3.30E−99 |
| SEUSS (b) | SEUSS | At1g43850 | 3.30E−107 |
|  | LUG/RON2 | At4G32551 | 5.20E−15 |
|  | LUH | At2G32700 | 2.10E−82 |
| UBC2 | UBC2 | At2g02760 | 4.10E−15 |
|  | UBQs | 14* | 6.50E−14 |
| UBC2 | UBC2 | At2g02760 | 1.60E−07 |
|  | UBQs | 14* | 3.30E−16 |
|  | SEUSS | At1g43850 | 1.00E−24 |
|  | UBC2 | AT2G02760 | 5.20E−11 |
| UBC2 | UBC2 | AT2G02760 | 6.50E−09 |
|  | AtUBA2 | AT5G06460 | 0.00026 |
|  | AtUBA1 | AT2G30110 | 0.00082 |

(a) and (b) represent independent purifications, the expectance value is based on homology between the peptide sequence and the protein.
*14 Ubiquitins having different accession numbers In both of the TAP experiments involving HUB1 as bait, its homologue HUB2 has been retrieved as well as a K-homology motif containing protein (renamed KH), an uncharacterized molecule with five KH domains that are involved in RNA binding. Spen-Like (SL) is another uncharacterized protein that appeared in the two technical repeats of one experiment as well as in the experiments done with the original TAP tag. This protein also has an RNA-binding domain (RRM) in addition to a SPOC domain at its C-terminus. Comparable results were obtained by using HUB2 as bait. The reciprocal purification of HUB1 and HUB2 suggests the formation of a tetramere structure to control histone H2B monoubiquitination. K3K7 has been retrieved in one technical repeat of a TAP experiment with HUB1. This protein contains five pentatricopeptide repeats (PPR) that function in RNA stabilization since the same domain is present in Chloroplast RNA Processing 1 (Crp1), a protein involved in RNA processing. TAP using SL as bait showed how tight its association with HUB1, HUB2 and KH is. Combining the TAP experimental data for HUB1, HUB2 and SL (and KH will follow) as baits we can conclude that the so-called histone H2B monoubiquitination tetramere core complex composed by HUB1-HUB2 contains at least two additional proteins: SL and KH. Both proteins have RNA binding modules. This kind of proteins has never been associated with histone H2B monoubiquitination so far, however the fact that this process, like the other epigenetic marks, is tightly associated to DNA and to newly generated mRNA, propose these proteins to have crucial roles in histone H2B monoubiquitination where their affinity for RNA could lead to incorporate in the HUB1/HUB2 complex upstream or feedback information (e.g. from small RNA molecules). UBC2 allowed pulling down the other basic components of ubiquitination complex like ubiquitin, represented by 14 UBQ different accession numbers that cannot be distinguished due to the high homology among them, and two E1 activating enzymes AtUBA1 and AtUBA2.

Third Experiment:

In order to identify direct interactors of HUB1, a yeast-2-hybrid experiment was carried out. For each of the selected proteins, AD and BD fusions were constructed whose expression was confirmed by Western blotting. HUB2, HUB1 truncated, SEUSS and KH strains showed self activation activity evidenced by a blue staining of colonies and were therefore not be used as prey in the Y2H experiment to avoid false positive results. Results are summarised in Table K:

TABLE L

Matrix with pair wise interactions.

|  | pDEST32 | | |
|---|---|---|---|
| pDEST22 | HUB1 | HUB2 no RING | SL |
| HUB1 | ++ | ++ | ++ |
| HUB1 no RING | ++ | ++ | − |
| HUB2 | ++ | ++ | − |
| HUB2 no RING | − | − |  |
| SL | ++ | − | ++ |
| SEUSS | + | + | − |

++, strong interaction; +, mild interaction; −, no interactions; interaction among the different HUB1, HUB2 and SEUSS versions have been tested in two independent experiments.

Full length and truncated version of HUB1 and full length HUB2 interacted in vivo. The RING domain seemed to influence the interaction of the HUB1 interactome complex that was most evident in the case of HUB2 where the deletion of this domain abolished the interaction between HUB1 and HUB2. The strongest interaction of HUB1 was with SL.

To test which portion of SL binds HUB1, two different versions of the protein were generated. The results showed that only the N-terminal region but not the C-terminal part interacts with HUB1. SL also showed dimerization activity and both regions of the protein seemed to be involved. HUB1 and the truncated version of HUB2 showed also a mild interaction with SEUSS. In addition SEUSS showed a strong interaction with itself reflecting homodimerization. A strong interaction between SEUSS and LUG/RON2 was detected and, as reported in previous studies, supporting the reliability of the assay. Neither HUB1 nor HUB2 were shown to have a detectable interaction with the E2 conjugating enzymes involved in histone H2B monoubiquitination (UBC1, UBC2, UBC3) that are present in the *Arabidopsis thaliana* genome, however it is possible that the HUB1/HUB2 dimeric or tetrameric complex is essential for the interaction with one of the UBC polypeptides.

Example 24

Phenotypic Characterisation of Spen-Like Mutant Plants

The Spen-like protein comprises an RNA recognition motif (RRM) in the middle of the sequence and a "spen paralog and ortholog C-terminal" (SPOC) domain in the C-terminal region; which is the typical composition of Split Ends (Spen) proteins.

*Arabidopsis thaliana* sl-1 (SALK_025388) and sl-2 (GABI_461F01) seeds were obtained from the Nottingham *Arabidopsis* Stock Centre and GABI-Kat respectively. Homozygous seeds were sown on Jiffy-7 pellet (jiffypot.com), vernalized overnight and subsequently grown in growth chambers under long day conditions as described above. At the time of flowering (with inflorescence stem length approximately 0.5 cm) leaf series were prepared by aligning all the rosette leaves on 1% agar plates (n=10). Leaves were photographed and scanned to measure leaf area by ImageJ 1.41. The number of leaves at flowering was also scored on the entire population (n=25).

Twenty-five plants of wild type (Col-0), hub1-4 (SALK_122512) (Fleury et al., 2007) and the two T-DNA lines (sl-1 and sl-2) were grown on soil for phenotypic analysis. Flowering time was slightly but significantly reduced in the case of sl-2 and highly altered in hub1-4. On the other hand, sl-1 shows a consistent reduction of the number of leaves at the moment of flowering while the time of this developmental switch was comparable to the one of Col-0 (FIGS. 22A and B). Ten plants of each genotype were grown until the flowering stem was approximately 0.5 mm tall and then analyzed for their leaf size, a measurement that gives a clear indication of the rosette size. The results of this analysis show that the area of almost all the leaves (cotyledons included) of sl-1 plants was significantly smaller than wild type. On the contrary, this reduction was milder in the sl-2 mutant and only few leaves were significantly smaller (FIG. 22C). The fifteen remaining plants were further grown to analyze the reproductive structures. The flower stem diameter of each genotype was measured and a significant reduction was observed in both sl-1 and sl-2 as well as for hub1-4. However, at the level of flower organs no obvious differences were noted among the sl alleles and with the wild type. These indications suggest that, unlike FPA (which comprises multiple RRM domains, in contrast to SL), SL is likely not involved in flower development as it has been shown by the absence of any flowering time phenotypes and alteration of flower structures (FIG. 22). SL does not show any flowering phenotype, but the alterations displayed by its mutants are restricted to growth. This is evident in FIG. 22B where, although flowering time is in line with the one of WT, sl-1 produces 1.3 leaves less than Col-0. In addition to this, traits clearly related to growth like leaf area and flowering stem diameter are significantly reduced. Flowers structures of sl-1 and sl-2 show no alterations and the production of siliques and therefore seeds is also not altered in any of the T-DNA lines. It has been shown in the previous examples that SL directly interacts with HUB1, an E3 ligase involved in histone H2B monoubiquitination that also has a function in plant growth (Fleury et al., 2007). According to these data, we therefore propose SL as a plant growth regulator by its influence on this epigenetic mark.

SEQUENCE LISTING (1045 sequences)

SEQ ID NO: 1 - DNA, 2637 bp, Arabidopsis thaliana
atggcgagcacaggcgagcctgaccgtaaaaggcgtcactttagctccatatcaccttctgaagctgcagccgccgtaaagaaacagcctttcttttggccctcctccgaggacaagcttgatactgcagttcttcagttccaaaatcttaagctatcacaaaagctagaggctcagcaggttgagtgttctattcttgaggataaactctctcagatcaaggaaaaacaattaccatacaactccagtttgaagactgtccataagtcttgggaaaagcttacagcttcagtggaatcatgctctgttcgtgtgagtgattcaagcagcggagctcataggtttgtaaacaaggaggatgggtcttctccagccgtgaaaaacgatttcatcaaccggctacttgaaactggtgctactgagagctcctcatccaatatctgctcgaatcagatggaagaaaatggagtgaatacgtcaagccagatgacgcaaaccttgtataatctagtagccgcgacagaggatttgaggtgtctgaaggatgaattatatcccacagttctcagaaccaatcttggtaaagatttgtgcggtcagctagctctgagtgagttggaatcagaaattaaaagtttcagaggggatctagatgatgtacttgtgaagttcaaatcactttctagagaattgcagagtcatcgcgatgctgatgctaaagttagagtagacctcaaacgaataagaggggagctagaggatgaggttgtggagcttcagcagtgtaatggtgacttgtcagcattgagagcagaaagggatgcaacagctggggcgtttttcccagtgttgagtcttggaaataagcttgctaccagtgatcgggagagggataaacaaagggatctgcaagacatggaaacagttctgaaagagttaacggtcctggcttcaggcaggctacaacagctaaaaaatcttcatgaggagaggacaaagatgcttggaaaaatgagtaatttacagaacaagtcaaagtctgtgaggtgcatctcatcttctcaagcctgcctttctttgaaagaccagctagaaaaatccaaagaagcagttttccagtatatggctttacttgagaaactgcaggttgaaaaagatagtatagtctggaaggaaagggagataaatataaaaaatgaactaggtgatgtttctcgaaagacgtctgctgttactgattctagaatggcttctttggattcggagatacagaaacaactggatgaaaaaatgcgaatcaagactaggctgggaaatatatcaagagagcgaggtagaaaagaaatctttgcagatatgaaggcattaatttcttcgttccccgaggaaatgagttccatgcgtagtcaattaaacaattataaagagactgctggaggtattcattctctgcgggctgatgtccagtccctctctggggttctatgtaggaagacaaaagagtatgaagcattgcaattgagatcagctgattatgcttctcagttaggtgacctgaatgctacggtttgtgatttgaagaacagtcatgaggagttaaagttgtttctggacatgtataaacgtgagtccactgatgcgagggacatagctgaagccaaggaacaggagtacagggcttgggctcatgttcagagtttgaaatcatcccttgatgagcaaaatctggagttgcgcgttaaggcagcaaatgaagctgaagccgtttcccaacaaatgttggctgctgcggaagcagagattgctgatttaaggcagaaaatggatgattgtaaaagggatgtcgccaagcattctgatatcttgaaatctaaacatgaagaacatggaacatatctttctgaaatacagacaattggaagtgcctatgaggacattgtaccgcaaaaccaacggcttttgcttcaagttacagagagggatgactataacatcaagcttttcttggaaggcataacttctaggcagatgcaagatactctgcttatcgataaatacatcatggataaggatatacagcaaggcagtgcatatgccagtttcctatccaagaaatcatcaagaattgaagatcagttgaggttctgcacagatcagtttcagaaactagcggaagataaatatcaaaagtctgtttctcttgaaaatctgcaaaagaaacgtgcagacatcgggaatggcttggaacaagctaggtcaaggctggaggagtcccattctaaagttgagcaaagtcggctggattatggggcattagaactggaactggagattgaaaggttcaataggagaaggatagaggaggaaatggaaatagccaaaaagaaagtttctcgtcttcggtctctcatagaaggatcatcggccattcaaaagctccgacaagaactcagtgaatttaaagaaattctgaagtgtaaggcctgcaacgatcgcccaaaagaggtggtgattacgaagtgctaccatttgttctgcaacccatgtgtgcaaaagctcacaggaactcgacaaaagaagtgtccaacatgctcagcaagttttggaccaaatgatattaaacctatctacatatga

SEQ ID NO: 2 - protein, 878 aa, Arabidopsis thaliana
MASTGEPDRKRRHFSSISPSEAAAAVKKQPFFWPSSEDKLDTAVLQFQNLKLSQKLEAQQVECSILEDKLSQIKEKQLPYNSSLKTVHKSWEKLTASVESCSVRVSDSSSGAHRFVNKEDGSSPAVKNDFINRLLETGATESSSSNICSNQMEENGVNTSSQMTQTLYNLVAATEDLRCLKDELYPTVLRTNLGKDLCGQLALSELESEIKSFRGDLDDVLVKFKSLSRELQSHRDADAKVRVDLKRIRGELEDEVVELQQCNGDLSALRAERDATAGAFFPVLSLGNKLATSDRERDKQRDLQDMETVLKELTVLASGRLQQLKNLHEERTKMLGKMSNLQNKSKSVRCISSSQACLSLKDQLEKSKEAVFQYMALLEKLQVEKDSIVWKEREINIKNELGDVSRKTSAVTDSRMASLDSEIQKQLDEKMRIKTRLGNISRERGRKEIFADMKALISSFPEEMSSMRSQLNNYKETAGGIHSLRADVQSLSGVLCRKTKEYEALQLRSADYASQLGDLNATVCDLKNSHEELKLFLDMYKRESTDARDIAEAKEQEYRAWAHVQSLKSSLDEQNLELRVKAANEAEAVSQQMLAAAEAEIADLRQKMDDCKRDVAKHSDILKSKHEEHGTYLSEIQTIGSAYEDIVPQNQRLLLQVTERDDYNIKLFLEGITSRQMQDTLLIDKYIMDKDIQQGSAYASFLSKKSSRIEDQLRFCTDQFQKLAEDKYQKSVSLENLQKKRADIGNGLEQARSRLEESHSKVEQSRLDYGALELELEIERFNRRRIEEEMEIAKKKVSRLRSLIEGSSAIQKLRQELSEFKEILKCKACNDRPKEVVITKCYHLFCNPCVQKLTGTRQKKCPTCSASFGPNDIKPIYI

SEQ ID NO: 3 - DNA, 51 bp, Artificial sequence
  primer: prm09774
ggggacaagtttgtacaaaaaagcaggcttaaacaatggcgagcacaggcg

SEQ ID NO: 4 - DNA, 57 bp, Artificial sequence
  primer: prm09775
ggggaccactttgtacaagaaagctgggttcatatgtagataggtttaatatcattt

SEQ ID NO: 5 - protein, 107 aa, Artificial sequence
  motif 1
  UNSURE (2)..(3): Unknown amino acid
  UNSURE (5)..(13): Unknown amino acid
  UNSURE (14)..(43): Xaa is any amino acid or no amino acid
  UNSURE (45)..(45): Unknown amino acid
  UNSURE (46)..(47): Xaa is any amino acid or no amino acid
  UNSURE (49)..(50): Unknown amino acid
  UNSURE (51)..(51): Xaa is any amino acid or no amino acid
  UNSURE (53)..(54): Unknown amino acid
  UNSURE (56)..(59): Unknown amino acid
  UNSURE (60)..(103): Xaa is any amino acid or no amino acid
  UNSURE (105)..(106): Unknown amino acid
CXXCXXXXXXXXXXXXXXXXXXXXXXXXXXXXXXXXXXXXXXXCXXXHXXXCXXCXXXXXXXXXXXXXXXXXXXXXXXXXXXXXXXXXXXXXXXXXXXXXXXXCXXC

SEQ ID NO: 6 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcggccttctcgcaggattcagcc

SEQ ID NO: 7 - DNA, 1827 bp, Oryza sativa
gcttgagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcg

SEQ ID NO: 8 - protein, 883 aa, Populus sp.
MGSTGEPDRKRRHFSSISSPTAAMAKKQPLSHLSEDKKLDTAVLQYQNQKLQQKLEAQKVEHSALENKFSLQKEKQKPYNSTLKAVNKSWEVLVTDLETCSNRTREWINGQDVKHVPIARDGGSSSLKDAFLSRLMETGATESSSATNCPDQMEVDRETAFEKNKRIAHNLVATINGLWYLKDGLRAAVLKQLTEDGRSILPQVSVLYLSWATSFRVFSVPMYVSPLLDACRETISNELETELKNLRLGLSDLHLKHKSLARELQNHRDSDAKNKAELKHLKGELETTVAELNDSNCKLATLKAERNATKGAFFPVLNMGSKHAAGDQVRDKQKDLQEMESAVKELLDQASSRLQELKDLHEERLKILQKLSNLQNLLKNVKSISSSRAYLLVRDQLEKSKSMVLHYRALFEKLQVEKDNLVWKERELNMKNDLVDVCRRSTAVVDSRVADLGKEIQKQINERNMIETNLEESSREPGRKDVIAEFKALVSSFPEEMGSMQSQLSNFKEASSDIHSLRADVQSLSTVLDRKVQDLNENILELKLILDMYQRESTYSRDVLEARDLEYKAWAQVQSFKFSLDEQNLELRVKTANEAEAISQQKLAAAEAEIADLRQKLEASKMDMSRLSDVLESKNEENEAYLSEIETIGQAYDEMQTQNQHLLQQVTERDDYNIKGVRARQLRDSLLMDKQTMEKEIQQANISVDFFDVKAARIEDQLKNCSDQVHKLAEDKFQRSVMLENTQKKLLDLRRSSNQARESLEDSQSRVERSRAALLEVQIDLEKEGFDKRRMEEELEVARREFSRLQEHTEGSSIVEKLQQELREYREIVKCSICLDRPKEAVITKCYHLFCNPCIQRIVESRHRKCPVCSMSFGHNDVKPVYI

SEQ ID NO: 9 - protein, 595 aa, Solanum lycopersicum
  UNSURE (551)..(551): Unknown amino acid
  UNSURE (581)..(581): Unknown amino acid
ASCRFGTRANDKARDKQRDMQDMESTLKEYLDQSSFRLFELKRLHEERIDILKQLSNLQNKLKNLKAICSSQPYILVKDQLAKAKEDLSLYQSLYEKLQVEKDNLSWREKEMNLKNDITDVFRRSSTIADSRIAWLEKEMQKHMQERNMIEGKLEEASREPGRKEIIAEFKKLVSSFPETMGDMQNQLSNYKETASDVHSLRTDVQSLSSFLDRKSKEIEALSAKSASQVTEMLKLQAVVNDLKESDMHLKLILEMYTRESAFSRDVFEARSSEYRAWARVQSLKTSLDEHNLEVRVKSAIEAEADSQQKLGAAEAEIAELRQKLDASKRERSRLSEVLKSKHEETEAYLSEIETIGQAYDDMQAQNQQLFQQITERDDYNIKLVLEGVRARQQRDCLAWESQITERAVEDANTMVSSYEMKAAKIDDQLRGCSDLIQKLAEDRGQNSLALENTQKRFLDVRKSSQQLRETLEEWQSKIDEVRVDLAQLQIELEKERFERKRAEEDVEALRRKTSRLRSHIERSSVIEKLQQKLREYKEILNCSICFDRRXEVVLAKWYHLFCNPCIQKIVETRHRKCPVXLCSFGANDVKAVYI

SEQ ID NO: 10 - protein, 884 aa, Oryza sativa
MGSTGEPDRKRRLSSSVAPGGGAPVSPAKRLAVAPTSEDKKLDFTVLKYKNQKLSEQLEAHKFEYRALENKFAGLKEKQRTHNETLSLVNSSWEQLVADLKSRSFCKSGSPNSSPGSGHNNVQKDGTCAPIERDTLRSLVESGATESSGCLPGCHLGSDAPPLHLSTANALGDIFFPSSDLLQANEECALAALTKLPENDRSKQLQSTSSNLLSSLNNVVQALSNLQLKHKQLAEDYQNQRDSSARKRAEHRRLKEELASAASELEETNYKLAALKAQRDNTQGARIPYPTLGNKNMPEDKVRDKQREMQDLEATHKELSELISKRLVEIKRLHEERIEILNKIATFQNILMDFKSIRSSKAFQLVNDRLQKSQAELDHYQTLLEKLQVDKDKFVWQERQFNLKVDLAEIPERVSTYCESSIADLKKDIQKLCDEKNMLILKLEEASREPGRNQVITKFKALVSSIPREMGAMQSEMTKHKEASLELNSLRAEVHSLSRILSRKERDNEEASCRSARAGSDITQLQSVISDLKQTNKELKLFADMYKRESTDSREIMESRDREFLEWAHVHALKSSLDESKLEQRVKAANEAEAITQQRLATAEAEIAESGQKLGTSRKDLVSLSHMLKSKQEECEAYRVEVECIGQAYEDIQAQNQQLLQQIIERDDDNTKIFMEGVKAKQTQDALHLETYSLRRNLQQESSLMDLYNQKIVSLEDQLKMWSDRVGKLQEDGWQQSVSLSNYQRKLVDVHRDAQKLMQSLDGIQANVGSSRLEVADLLIELEKERFSKKRIEDDLEVMSRKASSLRAKARESAVLEKLRHEVKEYRGILKCGICHDRQKEVVITKCYHLFCNQCIQKSLGNRQRRCPSCSLSFGANDVKPIYI

SEQ ID NO: 11 - protein, 878 aa, Vitis vinifera
MGSTGEPDRKRRHFSSLSPTAATAKKMPFLPVSEDKKLDTAVLQYQNQKLKQKLEAQKVECSALENKFSQLKETQQSYNTTLTLVNKTWRELVDNLETCSVHLKDSASAGRHVKLPSTTEDGNSCLQDAFLSRLIETGATESCSANDFSDRMEEDRPTSCGKTKNSLSNIVSTINDLWCLKDGLYAAVLEALPEDGLCNKKISSDLHAEVNNMRLAFGDLHLKHKSVTRDMQSHRDIDAKNKAELKRLRGELESTVAELEESNCKLVTLKAERDAAKGAFFPILSLGSKNVAGDKARDKQKDLHDMEATLKELLDQSSSRLLELKALYEERIGILKQLSNLQNTLKNVKCISSSSAYVLVTDQLEKSKAEVVHYQALFEKLQVEKDNLVWREKEVNMKNDFVDVFRRSSVVTDSRLSELRIEIQNQINERNLIEIKLEEASREPGRKEIIAEFKALLSSFPDNMGTMQNQLRKYKEAASDVHSLRADVQSLSSVLERKEKELETLSTRSADQVADIRKLQALIQDLEESDIQLKLILEMYRCESVDSRDVLEARDKEYKAWAHVQSLKSSLNEHSLELRVKTAIEAEALSQQRLAAAEAVIVDLRQKLEASKRDMFRLSDVLKSKHEENEAYLSEIETIGQAYDDMQTQNQHLLQQITERDDYNIKLVLEGVRSRQLQDSLLMEKQTMERGFQRATTSLGFFDMKAGRIEDQLKMCSDQVQKLAEDRLQSLGTLANFQKRLLDVTRLSQQARESLEESQSKVDKSRVSLGELQIELEKERFEKKRTEEELEVVRRKASRLRAQTEGSSIVDKLRQELREYRDILKCGICHERPKEVVITKCYHLFCNPCVQRIIEARNRKCPVCSASFGPNDVKPVYI

SEQ ID NO: 12 - protein, 846 aa, Physcomitrella patens
MLQFQNQKLAQQLDHQRSEISSLENRCCQLKGKQASYDDTLITVNRTWNLLEDDLELLAVRANANTNGLRVLEPVPTNKGPAVPPEETFLQRLLDKGATESSNCEGSISLSAVEAGLASRKAATMKTMKYLLLAIETQRSKNDELAMSLQNIVSPHEAGRILEESNDELRMEITNIRGVMDLLQLNHKEMSAEIGIARDLQTKDQSDIKRLTGELEETAADLEMCRRKLATLRSQKEAAAVAPPTVGTPKLGVKNEVGDRVPGADKASREARELEAALEETKTLASIRLNELQDALQTQLNLSQRLQHMKDALHDEHRILSSRPYLLLNDQAQFLKGEVERYRGLADKLQSDRDAMSRREKEVLLKAEAGEAARKASAIADARAAEIETKLQECLADRDVLQFRLEEVGQSSGRKDSVPELQVMISTLHKEMGMMQAQLNKFKEAACEVQSLRAEIHSLAGILERKTLECTRLSDQYVSQVADLIALKSEVEILRQSDQELQLILEMYERESTGPRNMMELQQDHSRTLVQVERLKRALDEHNLELRVKAANEVKAACEQRLAAAETEISEHRQRLDDSERVVMELKETLKSKSEEGDTYIAEIETIGQAYEEMQTQNSRLIHQITERDDYNTQLVAESLKAKQLQASLQSEKQILASRVQHANATAEHHKQRVSRLEDQARSYIEQIGKVMDNGRQHTLSMETLRRKTAETEKELLSVKTSLEATNKRIEDRGHKLAEAQQQLDKERFEKRRVQDELEALNNKLSRLRSHHERGPAIERLQEDIKEYKAILKCSVCHDRAKDVVITKCFHLFCGPCIQRNLEIRHRKCPACGIAFGQSDVRTVSI

SEQ ID NO: 13 - protein, 884 aa, Physcomitrella patens
MGSTEEPDRKRRHLNKDHLASPPVKKQPHTPSSEEKKVDAQMLQFQNHKLAQQLYVQRNEINVLEGKLNQLLSNQASFDDNLSKVSRVWNQVVDDLESLTVRYSSSSNGTYLLEPASNDRNNSSVSSEQTFLQRFLDNGATGSSTTNGSNDFVKSGLCSQQTSTAEILKLLVQSIDYEQVRNEELLSTFLNGIASNAVNLLPLVKEDEELYAETKKLRSLVDGFHLKHRELSAELGTCHDFQAKDRAELKRLKDELEEACADLEGVRHQLAALRSENVILSGPPTPSATLTSNKFEFGDGGASQEKVSKECCQLEADLEEVKTLAARRLMELQEALQNHLDVIKKFQHMQNELDDQERIVSSRQYQSLTEQVQHLRSEVERYRAMVDQLQGEHVSLLRREKEIALKTEAGDAAQKASTTSDDRAAALELKLRQCMSDCDSLRLRVEGATHASGVKESVADLEKVITSLHKDMSMMQAQLFEYKEAGSAVFSLRAELHSLRAIIDRKVSKHFCDTSAKRSTRISVCNLQFRVLRGSEKELKLIFDMYNKESNDSSEMRKLQQEECRAQAEMGRLQLALDEHNLELRVKNANEAEAACQQKLAAVEAEIAELRQSLQASYRVSLDLKESLQAKKEEGDPYISEIEAILHAYEDVQTQNQRLLQEIKERDEYNSQLMSESLKARQLQFPLQAEKQVLDADMQHANSDADLHKQRITYLEEQASTFIAHLEKATDENRQQSSAMESAKRKAVEAEKQLSSVKLALDAAHKLLEERGQNFLNVNLQLEKERFNKRRAREELEVLNMKITRLQTPHDSGPTVDRLREEIRNYEAILKCSVCQDRSKEVVITKCYHLFCSPCIQRNLELRHRKCPGCGIPFGQNDVRVVYI

SEQ ID NO: 14 - protein, 884 aa, Physcomitrella patens
MGSTEDSDRKRRNFNHSVSPVVMKQSLTPSSEKKKVDAQMLHYQNSKLSQLLEVQRNEINVLEGKLNQLHNKQVSFDENLSIVSRVWDQVVDDLELLTVRVGPTSNGTHALGSPHDRDNASFRPEQTFLQRLLDRGATDNSTINRSNGSVESGLFSRKADIAMTVTYLVQSIDYERARNDELVSSLRNDIASIGVNGSLAKADEELYAEAKKVRGFVEDLHLKHRQLSAELGTCGDFQAKDQAEVKRLKGELEEVCADLEANRRQLTAFRSQDATLSGSATPSATPTRKMFEVREGDAEQGKFPEENCELETGLEEAKSLAARSLTELQEAMHNHLDDIRKIQQMQVRFASIFIISFRQYQSLDEQVQYLRTEVEKYRAVVDELQVERVSLVRQEKEVILKAEAGDAARRAGAISDARAADLELKLQQCMSDCDTMRLRIEDATRASGVKESVADLKKESTNLHEDMNMIQTQLDDFKETGSAVHSLRAKLHSLHLILERKTLESRLLSDQYAGQVRELNFIQDEVCLGLRDSEKELKLILDMYDRELSDPREVRELQQADCRALAEVKRLQLALDEHNLERRVKDANEAEAACQQKLTAVDAEIAELRQNLDVSYKVAQDLRESLQTKKEEEDTYISEIDDITQAYIDMQIQNRKLLQEIIERDEYNAQLMSDSLKAKQLQTSLQAEKQVLNARMQHVIARADLHKQHVARIEDQARAFIHEHGKAIDESRHQSSAMESAKRKAVEMEKELASAKSALAAADKLLEERGQRLLNVNLQLGKESFRFEKRRAQEDLKIVNMKTARLHSLHDVGSTAERLQEQVNDYRAILQCNVCHDRNFQAIITKCYHLFCMPCIQRNLESKHRKCPGCGIPFGQNDVRSVYI

SEQ ID NO: 15 - protein, 1652 aa, Vitis vinifera
MGSLVGHVLPGLGFFLIGLWHLFNHIKLHAQNPHSYTSHPWFPTSKIRYLELFLIMIGCSISISMELFIGPVRHQPFDVDGTIPSNHLHNFEHSSISMTFLVYAASAIALDRAGVKARNDLSLLLAGIAFGQQLLLFHLHSTDHVGMEGQYHMLLQILISLSLTSTLMGIGLPKSFILSFVRSISILFQGLWLMVMGVMLWTPAYIPKGCFLRWEEGHQVAHCHDDKSLHRAKALINIEFSWYVIGMAMFSVFFYLFLVKVYGEKVKYWSMIGHFFPGLGFFLIGLWHLFNHIKLHVQNPKSFTIHPWFPASKIRYLELLLIMIGSSYYVFTELFRHHRFDPDGTIPSPYLRNFEHASIAITFIVYTSFSIVLDFVAAKAKYGLTQLLAAVALGQQLLMFRLHSTDHAGLEGQYHLFLQMLTLVSMATSLMAIGFPKSFILGFSRSLCILFLGVWLMATGVMLWTPGFIPKGCSLLWDEGGHQEARCHDDESLHRAKALINIEFSWYLIAIMIFSVSFYLFLVDAYGKKVKNLSWEKKEEKGFFLAHMASSMIGHFFPGLGFFLIGLWHLFNHIKLHVQNSKSFTIHPWFPAPKIRYLELLLVMIGSSYHMSAELFRHYRFDPDGTIPSPYLRNFEHASIGITFIIYSSSAIVLDFVAAKAKYGLTQLLAAVALGQQLLMFRLHSADHAGLEGQYHLFLQILTLVSTATSLMAIGFPKSFILGFSRSLCIIFLGVWLMATGVMLWTPGFIPKGCSLLWDEGHQEARCHDDESLHRAKALINIEFSWYLIAIMIFSVSFYLFLVDAYGDKVDATYLQYQNQKLVQQLEVQKHELHDLEDKIKELKDRQTSYDDMLITMNQLWSQLVDDLILLGVRAGGGQNAIQTLDHADHSRGLIPSCPAEEIFLCRLLETDSVESNGNDGIVKYVEEALALRHSSTLELIKSLEDTIDAQRVKTENIAQALHGKLSAEDAIIQLSKIDDLMKEEANNLREVIDALHLKHKEYVDGIQTYVHSHSVDQSEIKRLAGELEESMAELEESRRKLVNLKMQKDVASVVHTPVQGAVNGSLSPEKHADRTMGFRELKDSVEETKILAADRLSELHEAQEDNLILSKQLQDLQNELKDDKYVYSSRPYTLLNDQLQHWNAEAERYKLLTDSLQADRAQVVRREKELNAKSELADAARSVIENDSKIEELELQLQKCLIEKNDLEVKMKEALQDSGRKDIKAEFHVMASALSKEMGMMESQLNRWKETAHEALSLREQVQSLKALLNKKTNEQKCLADKCEEQMVEIKSLKALIEKLQKGKLELQIFVDMHGQESYDNRDLMEIKESEHKAHMQAEVLRNALDEHSLELRVKAANEAEAACQQRLSAAEAEIADLRAKLDASERDVLELKEAIRIKDVEAEAYISEIETIGQAYEDMQTQNQHLLQQVTERDDYNIKLVSESVKTKQMQSFLLSEKQALAKQLQQVNNALESLKMRIAQSEEQMKVCLAEALKYTQEDRHLAVSLETAKWELADAEKELKWLKSALASSEKEYEQIQRKKEEVQMELDNERSERLKLEEELKELNREIAEMSSESGEAAIQKLQDEIKDGKAILKCGVCFDRPKEVVIVKCYHLFCNPCIQRNLEIRHRKCPACGTAFGQNDVRFVKI

SEQ ID NO: 16 - protein, 878 aa, Arabidopsis thaliana
MASTGEPDRKRRHFSSISPSEAAAAVKKQPFFWPSSEDKLDTAVLQFQNLKLSQKLEAQQVECSILEDKLSQIKEKQLPYNSSLKTVHKSWEKLTASVESCSVRVSDSSSGAHRFVNKEDGSSPAVKNDFINRLLETGATESSSSNICSNQMEENGVNTSSQMTQTLYNLVAATEDLRCLKDELYPTVLRTNLGKDLCGQLALSELESEIKSFRGDLDDVLVKFKSLSRELQSHRDADAKVRVDLKRIRGELEDEVVELQQCNGDLSALRAERDATAGAFFPVLSLGNKLATSDRERDKQRDLQDMETVLKELTVLASGRLQQLKNLHEERTKMLGKMSNLQNKSKSVRCISSSQACLSLKDQLEKSKEAVFQYMALLEKLQVEKDSIVWKEREINIKNELGDVSRKTSAVTDSRMASLDSEIQKQLDEKMRIKTRLGNISRERGRKEIFADMKALISSFPEEMSSMRSQLNNYKETAGGIHSLRADVQSLSGVLCRKTKEYEALQLRSADYASQLGDLNATVCDLKNSHEELKLFLDMYKRESTDARDIAEAKEQEYRAWAHVQSLKSSLDEQNLELRVKAANEAEAVSQQMLAAAEAEIADLRQKMDDCKRDVAKHSDILKSKHEEHGTYLSEIQTIGSAYEDIVPQNQQLLLQVTERDDYNIKLFLEGITSRQMQDTLLIDKYIMDKDIQQGSAYASFLSKKSSRIEDQLRFCTDQFQKLAEDKYQKSVSLENLQKKRADIGNGLEQARSRLEESHSKVEQSRLDYGALELELEIERFNRRRIEEEMEIAKKKVSRLRSLIEGSSAIQKLRQELSEFKEILKCKACNDRPKEVVITKCYHLFCNPCVQKLTGTRQKKCPTCSASFGPNDIKPIYI

SEQ ID NO: 17 - protein, 899 aa, Arabidopsis thaliana
MENQESDEPMQKKPHLLDSVSPNSMARNSSPSHPIAKSVSFFDCDFSLLCLRLVDYEIDVDATVLQLQNQKLVQQLDLQKKQLYDVESKIQELQLNQTSYDDELISVNQLWNQLVDDLILLGVRAGANQEALNYLDIVDKKRVPPCAADETFLCRLLQVDSLDTSKSDEVVRKVEEALALRHSSTMELMGLFENTIDTQKTKAESISQSLHAVKSTEDATIQLSSINDLMKEESKNLREMIDALHVRHKEHSEQIQAYISSHSTDQSELKHLKGQLEEIKAELEENRRKLITLKMQKDAACEGHVTSPAIANGSLSPEKPVDKTKLRELKDSIDEIKIMAEGRLSELQASQEYNLSLSRQCQDIENELKDDQYIYSSRLYSLINDRIHHWNAELDRYKILTEAIQAERSFVMRRDKELNLRAESLEAANHKTTTVGSRIEVLEKKLQSCIIEKNGLELETEEAIQDSERQDIKSEFIAMASTLSKEMEMMEAQLKRWKDTAQDALYLREQAQSLRVSLSNKADEQKGLEDKCAKQMAEIKSLKALIEKLLKEKLQLQNLASICTRECNDDRGLAEIKDSQRKAQAQAEELKNVLDEHFLELRVKAAHETESACQERLATAKAEIAELRTQLDLSEREVLELKEGIKVKEQEAEASIAEMETIGQAYEDMQTQNQHLLQQVAERDDYNIKLVSESVKTKHAYNTHLSEKQVMEKQLHQVNASVENFKARIAHNEEQMKGCFSEAYKLIQEDRHLVISLETTKWEVADADKEFRWLKSAVSSSEKEYEQISRRTDDIKLELDDEREKKKLEEELMELNKELEELGSESVEAAIVRLQEEVKNCKNILKCGVCFDRPKEVVIVKCYHLFCQQCIQRSLEIRHRKCPGCGTAFGQNDVRLVKM

SEQ ID NO: 18 - protein, 597 aa, Medicago truncatula
MYRLCILLTYPTLFRVATAYWIPYHVPKRIVNQCWTGQKMQKVTGKRGWSDSAMEGKLSHENTLKNLKCITSSHAFQLVRDQTEKSKSEVQEYQALYEKLQAEKDSLTWREREWYIKNDLADLFQRSVEVSDLKVADIRTELRKTIEQRDVIENKLKEEAREPGRKEIIAEFKSLLSSFPEEMGSMQSQLSKYKESASDIHSLRADVHSISSILDQKVKECDALSVRSAGQLAEINRLLAVVQDLRVTEDEMKLILRMFRRETIDSRDVMEAREAEYIAWAHVQTLKSSLDEHNLELRVKTANESEARSQQKLAAAEAEIADMRHNLDDSKRATCKQSDVMRSKNEENEAYLSEIETIGQAYDDMQTQNQHLLHQITERDDYNIKLVLEGVRARQKQDSFIMEMRLMEQEMQQSNVSLNLYNTKAAKIEDQMRFCSDQIQKLVDNKLQSSVDLENTQRRLSDIRPSSQQVRNTVVEVQSKITSSRVTHMELLVDLEKERFAKKRVEKDLEVARRNFSHLKAQDEDSSETDKLQQELGEYRDIVKCSICRDRTKEVVITKCYHLFCNSCIQKIAGSRQRKCPQCGACFGANDVKPVYL

SEQ ID NO: 19 - protein, 883 aa, Oryza sativa
MGSTGEPDRKRRLSSSVAPGGGAPVSPAKRLAVAPTSEDKKLDFTVLKYKNQKLSEQLEAHKFEYRALENKFAGLKEKQRTHNETLSLVNSSWEQLVADLKSRSFCKSGSPNSSPGSGHNNVQKDGTCAPIERDTLRSLVESGATESSGCLPGCHLGSDAPPLHLSTANALGDIFFPSSDLLQANEECALAALTKLPENDRSKQLQSTSSNLLSSLNNVVQALSNLQLKHKQLAEDYQNQRDSSARKRAEHRRLKEELASAASELEETNYKLAALKAQRDNTQGARIPYPTLGNKNMPEDKELISKRLVEIKRLHEERIEILNKIATFQNILMDFKSIRSSKAFQLVNDRLQKSQAELDHYQTLLEKLQVDKDKFVWQERQFNLKVDLAEIPERVSTYCRNQVITKFKALVSSIPREMGAMQSEMTKHKEASLELNSLRAEVHSLSRILSRKERDNEEASCRSARAGSDITQLQSVISDLKQTNKELKLFADMYKRESTDSREIMESRDREFLEWAHVHALKSSLDESKLEQRVKAANEAEAITQQRLATAEAEIAESGQKLGTSRKYRIMLLNIVSLRTVEVGVTSLLGDLVSLSHMLKSKQEECEAYRVEVECIGQAYEDIQAQNQQLLQQIIERDDDNTKDVRFGYIVNLIVPETQYFIEKLFTCVKLIFMEGVKAKQTQDALHLETYSLRRNLQQESSLMDLYNQKIVSLEDQLKMWSDRVGKLQEDGWQQSVSLSNYQRKLVDVHRDAQKLMQSLDGIQANVGSSRLEVADLLIELEKERFSKKRIEDDLEVMSRKASSLRAKARESAVLEKLRHEVKEYRGILKCGICHDRQKEVVITKCYHLFCNQCIQKSLGNRQRRCPSCSLSFGANDVKPIYI

SEQ ID NO: 20 - protein, 844 aa, Oryza sativa
MDAAALQYENQKLVQQLEAQKSKMRALEGKFKELRDEQCSYDNTLICLNKMWNQLIDDLVLLGVRAGGDLNGLQALDHEEMSEESLESCPSEEIFLFRLLNSRNFRNNDDSSLSKLVEEALALRYSTTVTLMKSLQEAFAVQQARSESLSLALNGQNSSEDVIVALENHNDYLKEVVDNLRQAVSIINRKHEKYLDEIEAFKNNQSRELHEVKCLSGELEESMAELEESRRKLAVLQLQTGGGSLMNTSAPNGVNGSVSTDKSSDKGMGWRDLKDAVEEAKTLAANRLFELHETQEDNLILSKQLEDIQDQLKDENYIVTSKPYTILSDQLHHLNAEIERYRGLVEVLQNEKDQLMQKEEEMLAKAESVDAVQQSITTYKAKIEDLEHEIQKLMAEKNDLEIKAEEALQDSGKKDFKDEIHVMAASLSKEMELLDNQMNRSKDAASEALALREEADYLRTLLAKKIDEQKEISDRYNTQVTEIKSLKALIETLDQEKQELQFIVDMLGKECSESRAISEIEESENRARKQAEYLRKCLEEHNLELRVKAANEAETACQQRLSIAEAELEDLRAKVDASERDVMKLKESIRIKEAEVDGHISEIETIGQAYEDMQTQNQHLLQQVADRDDFNIKLVSDSVKMKQAYGSLLAEKNMLQKQLQHVNSSLESSKLKITSGEEQMKTYVAQAMKSSSENRHLAISLERTMLEVSDAEKELKWLRSATGSAEKEYEINQKKIAELKMELERERNERIKLEEEYEEVKNEVSELTSETEETTIQKLQDEIKECKAILKCGVCFDRPKEVVITKCFHLFCSPCIQRNLEIRHRKCPGCGTPFGQSDVREVKI

SEQ ID NO: 21 - protein, 700 aa, Saccharomyces cerevisiae
MTAEPATKKIKLELSDPSEPLTQSDVIAFQKEALFRCINRRRVDFEALRKQYELSRRECIDVSRKLANIMALIVTLARFIETFCTDANEKQLCREIAQGDETLIVQRSDSFMKLLTKYGKPNTTDSNTNSNASDHIQELTTELKNLRKSKEELFYENSQLTEEISALKEYYTNIIRKYDRDESFTIKRVFKEDKTDAVKELREDEKESNENNIKSGNKDSSAINGDNTSKKSEKGDELVQAEDERKEDAENEKLELDLKFSDLRAEINSLSSTIKDLENIRRENEEELIKTRSEVSNLKKQQIAAADQDPDFKSYDHESLLAKIQHLTEQNAELSEINSSFLSKFQVLAKEKEIYTKKVREEFQKSLDSLVEMNSSLEKDVVRIRTARDDLLSKIAILEAEKSKTEVLSDLQHAIDILKEQWTKIDQRSNDTKSSSTQDALIKEIQDLEKGFRELSDLTHKKYSEIINHESVISKLTVEKTKADQKYFAAMRSKDSILIEIKTLSKSLSKSNELILQLKDSDRLLQQKIGNLHKQLDLSQNNERRLIDSSKTETLKIIDLNNTSTKLKRSLEKLQEESNKSIADMTHLETKLNDTEIELKHFKQKASHLESKCEKLHDTLFRGNNKNKGSSDEALVEELANFRTLVYCSLCSKNWKNMAIKTCGHVFCENCCKERLAARMRKCPTCNKAFSSNDLLTVHL

SEQ ID NO: 22 - protein, 680 aa, Schizosaccharomyces pombe
MYQNGKPDAPTILGQKRELEDVEIQDDDIQEVSKEDLLKDVRVRSIQFDELESKIEGLQNLAEEKLKVLATLVSWWPEILQQFSVVFQGNELKDFESEGVFSILEKFPELSYFNDAVKNNKTKALSIIQKLLSTVDSSTNSVSRDPFSVLSIDDSALTEKLNTINLDIDKILDELDTTRSQLHSIIKLPDRSSSFTLQCINESVRPQSTKVKEEATTSSKGKDEEKKVSTVEQRTQLQQLSRLQDQQNGLMESRSQSLKILDSNVNEMDKLIMERENALNNVETTNLKKYSSFLALKEAVSMTSEQLRVLEHLLSECSHEINVLSQQSKNFNGVFESSYQPLINDLDHQISVMQNDEKRINNAKTELSLSLEKKLEAKKQKEKVYKDKLDELANLETMVLEKKKAVATREAANKIRLVDLNDLELQKDLSTYLSKELASTEKAFRLVKQQTVKSSHSHYQELITKFSVEKEKAEQKYFLTMKSTDSLHAEVKLLRQKYQKTNEIISKMLNSQDTAVHRIIEFEDQLARLSSVRNNSIKQSTTFQVKKSSQKSTIQNLEEKVSYLQQFMDKNNATLTDLEFQCSDLSSSIDILSKQDEEHEKEKRKLKDTGVSTSAEELKTFRAMCKCSVCNFERWKDRIISLCGHGFCYQCIQKRIETRQRRCPICGRGFGASDVIPIHL

SEQ ID NO: 23 - protein, 834 aa, Caenorhabditis elegans
MMKRSNEGIGGENYASSPSDDGQQKRRKIQFEPVRMPAVSNVNDIRARAVVYQTSKLKQQLLYKNKRIAELEKENERSKRRQQTDESNFLKVYNMFSDIEKYICTQTKNEFGEYIGGDTAPTGIDVLGMTNETYNKFFDQAKQNLRNAFVSYAKARHDRAHESTIFIDKLKTLIDSPTFNPNGVHKELTAKAASLAIQNEKLQSEVTKVQSDCYNLERKKRILTDKLSVQENRVQELEHQLEDARFETDKHMRLANKFEYKLATLVSEGQSGGNGGATPSSSGTTNATEKKISAPDIPPSETAAKEIENLRLERDEQESIASRRLQDLEEMNKKVQTLTQENSKLRLETQTFFSVDSIVNSEEYKNLKKYYSLAIKEYERVSKDLEDITTERDAFRSAKEARAMLMSEEHQKTLKEIQCQSDIHNSFYKVSHDSEVLRCEFETVKEEYNKTVKQSEWDEMKATLNTLRSMNRSLKSEKIRLREKDKQSQKDINTLKSELTSLKEAQDKCLLVPLEDVSNAPPEDVNKIRQEYESLCKEVKRLGAMEKQEKQKQVEKEVNRQIADKLSELETLRKTNEMLTNDEECISDELEAIGTAVEEEQERNAQLYIEKREQEDRNLKMMNDRMIQNQTFNRLREKLSCLESKAQTDAQIAKMHEFEKKANEELVTKLSESVQFKSAELTRLTNLMEQHRKNIQEVGMSRDENQIKADRCEGQMKQIQELYAAKAREIEDFKFKRQRAEEELETLRIKYERVKRNESVPAQSGDQVLEEANRQMKETLTCPSCKTRPKDCIMLKCYHLFCETCIKTMYDTRQRKCPKCNSNFGANDFHRIFI

SEQ ID NO: 24 - protein, 1044 aa, Drosophila melanogaster [sequence omitted]

SEQ ID NO: 25 - protein, 746 aa, Homo sapiens
MRLQELTDLLQEKHRTMSQEFSKLQSKVETAESRVSVLESMIDDLQWDIDKIRKREQRLNRHLAEVLERVNSKGYKVYGAGSSLYGGTITINARKFEEMNAELEENKELAQNRLCELEKLRQDFEEVTTQNEKLKVELRSAVEQVVKETPEYRCMQSQFSVLYNESLQLKAHLDEARTLLHGTRGTHQHQVELIERDEVSLHKKLRTEVIQLEDTLAQVRKEYEMLRIEFEQTLAANEQAGPINREMRHLISSLQNHNHQLKGEVLRYKRKLREAQSDLNKTRLRSGSALLQSQSSTEDPKDEPAELKPDSEDLSSQSSASKASQEDANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENKKMADEDALRKIRAVEEQIEYLQKKLAMAKQEEEALLSEMDVTGQAFEDMQEQNIRLMQQLREKDDANFKLMSERIKSNQIHKLLKEEKEELADQVLTLKTQVDAQLQVVRKLEEKEHLLQSNIGTGEKELGLRTQALEMNKRKAMEAAQLADDLKAQLELAQKKLHDFQDEIVENSVTKEKDMFNFKRAQEDISRLRRKLETTKKPDNVPKCDEILMEEIKDYKARLTCPCCNMRKKDAVLTKCFHVFCFECVKTRYDTRQRKCPKCNAAFGANDFHRIYIG

SEQ ID NO: 26 - protein, 1001 aa, Homo sapiens
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 27 - protein, 574 aa, Medicago truncatula
MYRLCILLTYPTLFRVATAYWIPYHVPKRIVNQNTLKNLKCITSSHAFQLVRDQTEKSKSEVQEYQALYEKLQAEKDSLTWREREWYIKNDLADLFQRSVEVSDLKVADIRTELRKTIEQRDVIENKLKEEAREPGRKEIIAEFKSLLSSFPEEMGSMQSQLSKYKESASDIHSLRADVHSISSILDQKVKECDALSVRSAGQLAEINRLLAVVQDLRVTEDEMKLILRMFRRETIDSRDLCRRDVMEAREAEYIAWAHVQTLKSSLDEHNLELRVKTANESEARSQQKLAAAEAEIADMRHNLDDSKRATCKQSDVMRSKNEENEAYLSEIETIGQAYDDMQTQNQHLLHQITERDDYNIKLVLEGVRARQKQDSFIMEMRLMEQEMQQSNVSLNLYNTKAAKIEDQMRFCSDQIQKLVDNKLQSSVDLENTQRRLSDIRPSSQQVRNTVVEVQSKITSSRVTHMELLVDLEKERFAKKRVEKDLEVARRNFSHLKAQDEDSSETDKLQQELGEYRDIVKCSICRDRTKEVVITKCYHLFCNSCIQKIAGSRQRKCPQCGACFGANDVKPVYL

SEQ ID NO: 28 - protein, 878 aa, Arabidopsis thaliana
MASTGEPDRKRRHFSSISPSEAAAAVKKQPFFWPSSEDKLDTAVLQFQNLKLSQKLEAQQVECSILEDKLSQIKEKQLPYNSSLKTVHKSWEKLTASVESCSVRVSDSSSGAHRFVNKEDGSSPAVKNDFINRLLETGATESSSSNICSNQMEENGVNTSSQMTQTLYNLVAATEDLRCLKDELYPTVLRTNLGKDLCGQLALSELESEIKSFRGDLDDVLVKFKSLSRELQSHRDADAKVRVDLKRIRGELEDEVVELQQCNGDLSALRAERDATAGAFFPVLSLGNKLATSDRERDKQRDLQDMETVLKELTVLASGRLQQLKNLHEERTKMLGKMSNLQNKSKSVRCISSSQACLSLKDQLEKSKEAVFQYMALLEKLQVEKDSIVWKEREINIKNELGDVSRKTSAVTDSRMASLDSEIQKQLDEKMRIKTRLGNISRERGRKEIFADMKALISSFPEEMSSMRSQLNNYKETAGGIHSLRADVQSLSGVLCRKTKEYEALQLRSADYASQLGDLNATVCDLKNSHEELKLFLDMYKRESTDARDIAEAKEQEYRAWAHVQSLKSSLDEQNLELRVKAANEAEAVSQQMLAAAEAEIADLRQKMDDCKRDVAKHSDILKSKHEEHGTYLSEIQTIGSAYEDIVPQNQRLLLQVTERDDYNIKLFLEGITSRQMQDTLLIDKYIMDKDIQQGSAYASFLSKKSSRIEDQLRFCTDQFQKLAEDKYQKSVSLENLQKKRADIGNGLEQARSRLEESHSKVEQSRLDYGALELELEIERFNRRRIEEEMEIAKKKVSRLRSLIEGSSAIQKLRQELSEFKEILKSKASNDRPKEVVITKCYHLFCNPCVQKLTGTRQKKCPTCSASFGPNDIKPIYI

SEQ ID NO: 29 - DNA, 2762 bp, Populus sp.
gttttgttttgttgttgcaattttttttcaatggggagtacaggtgagccagacagaaaacggcgtcacttcagctccatatcatcaccaacagctgctatggctaaaaagcagccgttatcgcatctgtccgaggacaaaaagcttgatactgctgttcttcaataccaaaatcaaaagcttcaacagaagttagaggctcagaaggttgagcattctgcacttgaaaacaagttctctctacagaaggagaaacagaaaccatacaattctacattgaaggctgtcaataagtcttgggaagtgctggtgactgacttggaaacatgttccaaccgcacaagagagtggatcaatgggcaagatgtcaaacatgtaccaatcgcgagagacgggggctcatcttctctcaaggatgcatttcttagcagacttatggaaactggtgcaactgaaagttcctctgcaactaactgccctgatcagatggaagtggatagagaaactgcctttgaaaagaataaaaggattgcacataatttagtggctacaatcaatggcctttggtatctgaaggatggattacgtgcagcagttttgaaacagcttacagaagatggtaggagtatattgccacaggtgtctgtgttatatttgtcttgggctacttccttcagagttttctcagttcctatgtatgtttctcctttgctagatgcttgtagggaaacaatatctaatgaattggagacagaacttaagaacttgaggttagggctaagtgatcttcatttgaagcacaaatcactggcaagggaattgcagaaccatcgagacagtgatgcaaaaaataaagctgagcttaagcatctaaaaggtgaattggagaccacagttgcagaattaaatgacagcaactgtaaattggcaacacttaaagcagagagaaatgcaactaaaggggcattcttccctgtcttaaacatgggaagcaagcatgctgctggtgatcaggtcagggataaacaaaaggatcttcaagaaatggagtctgctgtcaaagagcttttagaccaagcttcctctcgactacaagaactaaaagatcttcacgaagaaaggttaaaaatattacagaagctatccaatttgcagaacttgttgaagaatgtgaagagtatatcttcatcacgagcctaccttttggtgagagatcaactagagaaatcaaaatcaatggttctccattatcgtgccttatttgagaaactacaggttgagaaggataaccttgtctggaaggaaagggaattaaatatgaaaaatgatttagttgatgtttgtcgaagatctactgcggttgtggattctagagttgctgatttaggaaaggagatacagaaacagattaacgaaagaaacatgattgagactaatctggaagagtcatcaagagaaccaggaagaaaagatgtgattgctgaattcaaagcattggtttcttcatttcctgaggaaatgggctctatgcaaagccaattaagtaacttcaaagaagcttcttctgatattcattctttgcgggctgatgtgcagtctctttctactgttctggataggaaggtccaagatctgaatgaaaacatactggagttgaaactgattttggacatgtatcaacgtgaatccacttattcaagggatgtcttggaagccagggatctggaatataaggcatgggctcaagttcaaagttttaaattctctcttgatgagcaaaacttggaattacgagtgaagacagcaaatgaagccgaggccatatcccagcaaaagctagcggctgcagaagctgagattgctgatttgagacagaaactagaagcttctaaaatggatatgtctagactttctgatgtcctagaatcaaaaaatgaagaaaatgaggcctacttatctgaaatagagacaattggtcaagcatatgatgaaatgcaaactcaaaatcaacatctgttgcagcaagtaacggagagagatgattataacattaagggtgtgagagcaagacaactgcgggattctctgctgatggacaaacaaaccatggaaaaggagattcagcaagccaatatttccgttgatttctttgatgtgaaagctgcaagaatagaagatcagttaaaaaattgttcagaccaggttcataaacttgcagaagataagtttcaaaggtcggttatgttggaaaatacacaaaagaaattgctagatttgagaagatcatctaatcaagcaagagagtcattggaggattcccaatctagagttgaaagaagtcgagctgctcttttggaggtgcagatagatctagagaaagagggatttgacaagagaagaatggaggaggaattggaagttgcaaggagagagttttctcgtcttcaagaacatacagaagggtcttcgattgtagaaaagcttcaacaggaacttagagaatacagggaaatagttaagtgcagtatctgccttgacagaccaaaagaggctgtcattacaaaatgctatcatttgttctgcaatccctgcatacagagaattgttgaaagtcgtcaccgcaagtgtccagtgtgtagcatgagttttgggcataatgatgtgaagccagtttacatctgatggcatgggaatgaggtgtaccgtgctgtttgatgatgaggctcgttttcaaagtcaggtcccaatgaggcttgtctgcc

SEQ ID NO: 30 - DNA, 1828 bp, Solanum lycopersicum
  misc_feature (1652)..(1652): n is a, c, g, or t
  misc_feature (1662)..(1662): n is a, c, g, or t
  misc_feature (1742)..(1742): n is a, c, g, or t
gcctcgtgccgattcggcacgagggctaacgataaggcgagagataagcagagagacatgcaggatatggaatccacacttaaggagtatttggaccaatcctctttccgtctattcgaactcaagcgtcttcatgaagaaaggatagacatattgaagcagttgtccaacttacagaacaaactaaagaatctgaaagccatatgctcttcccaaccatatatcttggttaaagatcaacttgcgaaagctaaagaggatctatctctttatcagtccttatacgagaaactacaggtggagaaagacaatctttcgtggagggaaaaagaaatgaatttgaagaatgatataactgatgtttttcggcgatcttccaccattgctgattccagaatagcctggttagaaaaggagatgcagaaacacatgcaagaaagaaatatgattgagggcaagctggaagaagcatcaagagaacctggtaggaaagaaattattgctgaatttaagaaattggtttcttcattccctgaaaccatgggcgatatgcagaatcagctaagtaattataaggagactgcttcagatgttcattcactacgaactgatgttcagtcactttccagttttcttgaccggaagtcaaaagagatagaagcattgtctgccaagtcagcttcccaggtgactgaaatgctgaagttgcaagctgtggttaatgatttgaaagagagtgatatgcatttaaagctcattttggaaatgtatacgcgtgaatctgctttctcaagggatgtttttgaggctcggagttccgagtacagagcttgggcacgtgttcagagtctgaagacttctcttgatgaacacaatttggaagtgagagtgaaatctgctattgaagccgaggctgactcccagcagaagctaggtgctgcagaagctgagattgctgagctgagacagaagttagatgcttctaaaagggaacggtctagactctcggaagtcttgaagtctaagcatgaagaaaccgaggcctacctctctgagattgagacaattgggcaggcctacgatgatatgcaagctcaaaatcagcagcttttccagcaaatcacagagagagatgattacaatataaagcttgttttagaaggagtacgggcaagacaacagcgggattgtttggcttgggaaagtcaaatcacagagagagcagttgaagatgccaatacaatggtcagttcctatgaaatgaaagctgccaaaattgatgaccagttgaggggatgctcagacttgatccagaagcttgctgaagataggggtcagaattctcttgctttagagaacacccaaaaacggtttttagatgtaagaaaatcttcccagcaattgcgggagacgctggaagaatggcaatccaagatcgacgaagttcgagttgatcttgcacagttgcagatagaactagagaaagaaaggtttgagagaaaaagagcagaggaggatgtagaagctctgaggagaaagacttcacgtttgagatcacacattgaaaggtcatctgttattgagaagcttcagcaaaaactaagggaatacaaggaaatactcaattgtagtatttgctttgataggcgcanagaggttgtnctcgcaaaatggtaccatctcttttgtaatccgtgtatccaaaaaattgtggagactcgtcaccgcaaatgtcctgtctngctctgcagctttggagcaaatgatgtcaaggccgtttatatctgatcagaaacatgaggatgtctaggccttttattatgtcact

SEQ ID NO: 31 - DNA, 3135 bp, Oryza sativa
atggggagcacgggggagcccgaccggaagcggcggctcagtagctccgtcgcgcccggcggcggggcccctgtttctcctgccaagcggctggcggttgcacccacctccgaagataagaagctcgattttactgtactcaaatacaaaaaccaaaagctctcagagcaactagaagcccacaagtttgagtatcgtgctcttgaaaataaattcgctgggctaaaagagaagcagaggactcataatgagacactttccttggtcaacagttcttgggaacaacttgtggcagacctgaagtcaagatctttttgcaaaagtggatctcctaattccagccctggttcagggcacaacaatgtacaaaaggatggtacttgtgcacccatagagagggacactcttagaagtcttgtggaatctggtgcaactgaaagttcaggttgtttgcctggttgccacttgggaagtgatgcccctccattacatctatccacagctaatgctcttggggatatcttttttccatcaagtgatcttttgcaagcaaatgaggagtgtgctttggctgctctcactaaattaccagaaaatgaccgcagtaagcaactacagagtactagtagcaacctgttgtccagcctcaataatgtcgtacaagcattaagtaatcttcagttgaagcacaagcagttagcagaggattatcaaaatcaaagagattccagtgcccgaaaaagagctgaacatagacgtctaaaagaggagttggccagtgctgcttctgagttggaagaaactaactacaaactggcagcacttaaagctcaaagagataatacacaaggagctcgaatcccatatcctacattaggaaacaaaaatatgcctgaagataaggtcagagataaacaaagagagatgcaggatcttgaagctactcacaaggaattatcggaattgatttcaaagcggttggtggaaattaagagattacatgaagagagaattgaaattttgaacaaaatagcaacttttcagaatatcttgatggatttcaagagcattcgttcttcaaaagcttttcagcttgttaatgatcgacttcagaagtcacaagcagaattggatcactaccagacattattagagaaattacaggttgataaggataagtttgtgtggcaagaaaggcaatttaatttgaaagttgatctggctgagattcctgagagggtttctacatattgtgagtctagcattgctgatctcaagaaggatattcagaaactatgtgatgaaaaaaacatgcttattctcaaacttgaagaggcttcaagagaacctggtcggaatcaagttattacaaaatttaaagctttagtgtcatcgataccaagggaaatgggcgcgatgcagagtgaaatgaccaaacacaaggaggcttccttggagttgaattctttgcgagcagaagtccattcactttctcgcattctgtccagaaaggaacgtgataatgaagaagcatcatgcagatctgcccgtgcgggatctgatataacacaacttcaatcagtgatttctgatctgaagcaaactaataaggagcttaagttgttcgcggatatgtataagcgtgaatccactgattccagggaaataatggaatccagagatagggaattccttgaatgggctcatgttcatgccctgaaatcatctcttgatgaaagtaagctagagcagcgtgttaaggctgccaatgaagctgaagcaatcacacagcagaggctagcaactgcagaagctgagattgctgaatcagggcagaagcttgggacttctagaaaggatctagtcagtttatcccatatgctgaagtctaaacaggaagaatgtgaagcttacagagtggaggtcgagtgtatcgggcaagcatatgaggacatacaggcacaaaaccaacaattgctacagcagattattgaaagagatgatgataataccaagatttttatggagggtgttaaagcaaaacagacacaagatgctttgcatttggaaacatattctttgcgcagaaacttgcagcaggaaagctctttgatggatctgtacaaccagaaaattgtttccttagaagatcagcttaaaatgtggtctgatcgggttgggaaacttcaagaggatggatggcaacaatctgtttcattgagtaattaccaaagaaagctggttgatgtgcacagagatgctcaaaagcttatgcaatcattggatggaatacaagcgaatgttggaagcagtcgtttggaagtcgctgatctgcttatagaacttgagaaagagaggtttagtaagaagagaatagaggatgatttggaggttatgtcaaggaaagctagctctcttagagccaaggcacgtgaatcagcagtcctggaaaagcttcgtcatgaggtcaaggagtatagggggatattgaagtgtggtatctgccatgataggcagaaggaggttgtgattaccaagtgctaccatctcttctgcaatcagtgcatacagaagtcccttgggaaccgacagaggagatgtccttcatgtagcttgagttttggggctaatgacgtgaaacctatctacatatgaggttgttaatttcaagatggtatcgcaggcatctagatcaagctactttgatggtcattacttggtcatatggttagatgaccatgcgagttgaagatatgacaagtactagcttgtacaaccaaacatataagcagaatgtagtagcctaatttggttggctacatggaattgcaggtgtctggcattcgtgatgctaatgtttattcctgctcccttgtatagttcgggattctcctggagtagttaagtcgctagattagtctgacttttgctatatccattctgttcttttggggaaaaaacatccaacaaaaggggtggtgcttcccgccatactgaaacattgtaccatatatagcttgtagttccattgttgtagcagacaataagaatgtaggtcttacgggttttccagattgtacatttcaggagattggcaatagcgaaatttcagttggatgcagtttgtttggtctt

SEQ ID NO: 32 - DNA, 2637 bp, Vitis vinifera
atggggagcacaggtgaaccagaccgaaaacgacgtcactttagctctctgtcgcccacggctgctactgctaagaagatgccattcttgcccgtatctgaagataaaaagcttgatactgctgtacttcagtatcaaaatcaaaagctaaaacagaagttagaagctcagaaggttgagtgttctgctcttgagaataagttcagccaactgaaggagacacaacagtcatataataccacattaacactggttaataaaacttggagagagctggttgataacttggaaacatgttctgtccacctaaaggactcagcaagtgctggacgacatgttaaacttccttcaacaacagaggatggaaactcttgcttacaggatgcttttctcagccggctcatagaaacgggtgcaactgaaagttgctctgcaaatgacttttctgatcggatggaagaagacagaccaacatcctgtggaaagactaagaacagtttaagtaatattgtatctaccattaatgatctgtggtgtttgaaggatggattatatgccgcagttttagaggcacttccagaagatggtttatgcaacaaaaagatatccagtgatttacatgcagaagttaataacatgagattggcatttggtgatcttcacttgaagcacaaatcagtcacaagggacatgcagagccatcgggacatagatgccaagaataaggctgagcttaaacgtttaagaggggaattggagagcactgttgcagagctggaagaaagtaattgtaaattggtaactcttaaagcagagagagatgcagctaaaggggcatttttccccatcttaagcttggggagtaaaaatgttgcaggagataaggccagagataaacaaaaagatctgcatgatatggaggctacactcaaggagctattggaccaatcttcatctcgcctactagaactgaaggctctttatgaagaaaggataggaatattaaagcaactatctaatttgcagaacactttgaagaatgtgaagtgcatttcgtcttcttcagcctatgtcttggtaacagatcaactggaaaagtcgaaagcagaagttgtccattatcaggccttatttgagaaactacaggttgagaaggataaccttgtctggagggaaaaggaagtgaatatgaaaaatgactttgttgatgtttttcgaagatcttctgtagttactgattctagattatcagagctcagaatagagatacagaatcaaattaatgaaagaaacctgattgaaattaagctggaagaggcatcaagagaaccaggaagaaaagaaatcattgcagaatttaaagccctactttcttcatttcctgacaacatgggcactatgcaaaatcaacttcgtaaatacaaagaggctgcttccgatgttcactctctgcgggctgatgtgcagtctctatccagtgttcttgagaggaaggaaaaagagttggaaactttatccactagatctgctgaccaggttgctgatatacggaagttgcaagctttgattcaggacttggaggagagtgatatacaattgaagcttattttggaaatgtatagatgtgaatctgttgattcaagggatgtcttagaagctagggataaagaatacaaggcatgggctcatgtgcaaagcctcaagtcttctctcaatgagcatagcctggaattgcgagttaaaacagcaattgaagctgaagccttatctcagcaaaggctagctgctgctgaagcggtgattgttgacctgagacagaagttggaagcttctaagagggatatgtttagactctcagatgtcctgaaatccaagcatgaggaaaatgaagcctacttatctgagatagaaacaattgggcaggcatatgatgatatgcagactcaaaaccaacacctattgcagcaaatcactgagagagatgactataacattaagcttgttttagagggtgtgaggtcaagacagctgcaggattctctactgatggaaaaacaaaccatggagaggggatttcaacgagccactacatctcttggtttttttgacatgaaagctggaagaattgaagatcagttgaagatgtgctcagatcaggttcaaaaacttgcagaagatagattgcaaagcttaggtactttggctaatttccaaaaaaggttactggatgtgactagattatctcagcaagcaagggagtcactggaggaatcacaatccaaagtcgacaagagtcgagttagtcttggagagctgcagattgaactagagaaagagaggtttgaaaagaaaagaacagaggaggaattggaagttgtaaggagaaaggcttcacgtcttagagcacagacagaggggtcatcgattgtggacaagcttcgacaggaactcagagaatacagggatatactgaagtgcggtatatgccatgagaggccaaaagaggttgtcatcacaaaatgctatcacttattctgcaatccctgtgtgcaaagaattattgaagctcgtaaccgcaagtgtcctgtatgttctgcaagttttgggcccaatgatgtcaaacccgtttacatctga

SEQ ID NO: 33 - DNA, 2541 bp, Physcomitrella patens
atgctccagtttcagaatcagaagttggcacagcagctggatcaccagcgttcagagattagttctttggagaacaggtgttgtcagttgaagggcaagcaggcttcttacgacgacactctaatcactgtgaaccgtacatggaatctgcttgaggacgacttagagttgcttgcagtgcgcgcaaacgccaacacgaatggcttgcgagtgcttgaacctgtgccgacgaataagggtccggctgttccgcctgaagagactttcctgcagaggctcttggataaaggggctactgagagtagtaattgtgaaggaagtattagtctgtctgcagtggaggctgggctagcttctagaaaggctgcgactatgaagaccatgaaatatctcctgctagctattgaaactcaacggtcaaagaatgacgaacttgcaatgtccttgcaaaatattgtgagtcctcacgaagcaggacgaatattggaggaatcaaatgatgagttacgtatggaaataacaaatatacgtggtgttatggatttattgcaattgaatcacaaagaaatgtcggctgaaattgggattgctcgggaccttcaaaccaaagaccaatctgacatcaaacgcctaactggggaactggaggagacagcagctgatctggaaatgtgtcggcggaagctagcaacacttcgcagtcaaaaggaagctgcagctgttgcaccgcctactgtaggtacacctaagctaggtgtcaagaatgaggttggagatcgagttccaggcgcagataaagcttcaagagaggctcgtgagctggaagctgctttagaagaaacaaagacattggcgtcgataaggttaaatgagctacaagatgcgttgcaaacgcaactgaacctctcacagcggttgcaacacatgaaggatgcgctgcatgatgagcacaggatcttgtcatctcgtccctatttattactcaacgaccaagctcagtttttaaagggtgaggtcgagcgctatcgaggtctggccgacaagcttcagagtgatcgtgacgcaatgtcccgaagagagaaagaggttttattgaaggcggaggctggtgaagcagcccgtaaggcaagtgccattgctgatgcaagagctgcagaaatagagactaaacttcaagagtgcttggcagatcgggacgttttgcaattcagattagaggaagtcggtcaatcttcaggaaggaaagattcagtgcctgaattacaggtgatgatctccacattgcacaaggagatgggcatgatgcaggcacaattaaataaattcaaggaagccgcttgcgaggttcagtctcttcgtgcagagatacactccttggctggtatccttgaaagaaagacattggaatgcacacgcttgtcagatcaatatgtctcccaagttgctgatttgatagccttgaaatctgaggtggaaattttgagacaaagtgatcaagaactgcagcttattctggaaatgtatgagagagagtcgactggtccaaggaatatgatggagttgcagcaggatcatagcagaacattagtgcaagttgagcgcttgaagagagcactggatgaacacaacttagagcttcgggtgaaagctgccaacgaggtcaaggctgcatgtgaacaaagacttgcagctgctgaaactgagatttctgagcatcggcagaggctagacgattccgaaagggttgtgatggaactcaaggagacgttaaaatccaagagtgaggaaggggacacatacatcgctgaaattgagactatcggtcaagcatacgaggagatgcaaacacaaaattctcgattaattcatcaaatcactgaacgcgatgattacaatacccagcttgtggcagagagtctgaaggctaaacagctgcaggcctctcttcagtcagagaagcaaatattggctagtcgtgtgcagcatgcaaatgctactgctgagcatcacaagcagcgtgtaagccgattagaagatcaggccagatcatacatagagcaaataggcaaggtcatggacaatggcaggcaacacacattatccatggagactctcagacgaaagacggctgaaactgagaaagaacttctctctgtaaagacgtcactagaagctacaaacaaaaggattgaagatcgtggtcacaaactcgctgaagctcaacagcagcttgacaaagaaagatttgagaaacgaagggttcaggatgagctggaggcgctgaacaataagttgtcacggttgcgatcacatcatgagagaggccctgctatagaaaggcttcaggaggatataaaagaatataaagctattctgaagtgtagcgtctgtcatgaccgtgcaaaagatgtcgtcatcacaaaatgcttccatttattttgcggcccctgtatccagaggaacttggagatcagacatcgaaaatgtcctgcttgcgggatagcatttggccagagtgatgttcgaactgtcagcatctag

SEQ ID NO: 34 - DNA, 2655 bp, Physcomitrella patens
atgggaagcacagaagaacctgaccgtaaacgacgccaccttaacaaagatcatctggcgtcacccccagttaagaaacaacctcatacaccctcatctgaagagaagaaagtggatgcccaaatgttgcagtttcaaaatcataagcttgcccagcagctctatgttcagcgcaatgaaataaatgttttggagggcaaactgaatcaacttcttagcaaccaggcctcatttgatgacaatctctcaaaagtcagtcgggtttggaatcaggttgtggatgatttggagtcgcttacagtgcgatacagttcctcatctaatggaacttatttactggaacctgcctctaatgatcggaacaactcctcagtttcttctgagcaaacttttctccaacggtttctcgataacggagctaccggaagttccacaaccaatggaagcaacgacttcgttaagtctggactctgcagtcaacagacgtctaccgctgaaatcttgaaacttcttgtgcaaagcattgattatgagcaagttcgaaatgaagagcttttgagcactttcctgaatgggattgcttccaatgcagtgaaccttcttccgcttgtaaaggaagatgaggagctatatgctgaaacaaagaaattgcgcagtcttgtggatggatttcatttaaagcaccgagaactctcagctgagcttggaacttgtcatgattttcaagcgaaggatcgagctgagctcaaacgattaaaagacgaactcgaggaagcttgtgctgatctagagggtgttaggcaccagttggctgcgctacgttctgaaaatgtgattttatctggtccgcctacacctagtgccactttaactagtaataaatttgaatttggagatggaggtgcatcacaagaaaaagtttcgaaagaatgttgtcaactggaagcagacttggaagaggtcaagactttggcagctcgaaggctcatggagcttcaagaagctttgcagaatcatttggatgttattaaaaaatttcaacacatgcagaacgaactggatgaccaagagcgcattgtgtcttctcgacaatatcagtcactaaccgagcaagttcaacatctgaggagtgaagttgagaggtatcgggctatggtggaccaattacagggtgagcatgtctctcttttacgtcgcgagaaagagattgcattgaaaactgaagctggtgatgcagctcaaaaggctagcaccacctcagatgatcgggcggcagctttggaattaaagttacggcagtgcatgtctgattgtgattctttgcgtctaagagttgaaggcgctactcatgcttcaggtgtaaaagagtcagtagctgatcttgagaaagtgattaccagtcttcataaagacatgagtatgatgcaagcacaactattcgagtataaagaagcaggctcagctgtcttttctctgcgagcagagcttcattctttacgtgcaatcattgataggaaagtaagcaaacacttttgtgacacatctgcgaaaagaagtacgagaatatctgtttgtaacttgcagttcagggttttgcgaggtagtgagaaagaactgaagcttatcttcgatatgtataacaaggagtcaaatgattcaagtgaaatgaggaagttacagcaggaagagtgtagagctcaggcagaaatgggacgattgcaattggccctggacgaacacaatctagaacttcgcgtaaaaaatgcaaatgaagcagaggcagcatgtcaacagaagcttgctgcagtggaagctgagattgcagagctgcggcagagtctacaagcttcgtacagggtttctctagatttaaaggagtccctgcaggccaagaaagaggaaggggatccatatattagtgaaatagaagctattttacatgcgtacgaagacgtgcagactcaaaatcagaggctacttcaagaaatcaaagagcgcgacgagtacaattctcagttaatgtcggagagcctcaaggcgagacagctgcagtttcctctacaagccgagaagcaagtgttggatgccgatatgcagcatgcaaattctgatgctgatcttcacaaacagcggataacttatctagaagaacaagctagtacattcattgctcatcttgagaaagcaacagacgagaatcggcagcaatcgtcagcaatggaaagtgcgaaacggaaggctgttgaagcagagaaacagttgtcttctgtcaagttagcgcttgatgctgctcacaaattgttggaagagcgtggtcaaaatttcctaaatgtaaacctgcaattagaaaaggaaaggttcaacaaaagaagagctcgagaagagttggaggttctgaatatgaaaataacacgcctgcaaactcctcacgatagcggacctacggtagaccgattacgcgaagaaatcaggaactacgaggccatattgaaatgcagtgtgtgtcaggatcgatccaaggaggtggttattaccaagtgctaccatctattctgtagtccttgcattcaacggaacctcgaacttcggcaccggaagtgtcctgggtgtgggattccgtttggacagaatgacgtgcgagttgtgtatatttga

SEQ ID NO: 35 - DNA, 2655 bp, Physcomitrella patens
atgggaagtacagaagattctgaccgcaaacgccgcaactttaatcattctgtatcccctgtagtcatgaaacaatctcttacaccttcatctgaaaagaagaaggtggatgctcagatgttgcattaccaaaattctaagctttctcagctgctcgaggtccagcgcaacgaaataaatgttctggagggaaaattgaatcaacttcataacaagcaggtctcattcgatgagaatctctcaatcgtcagccgcgtatgggatcaggttgtggatgacttagagctgctgacagtacgagtcggtcctacatccaacggaactcatgctttggggtctccccatgatcgggataatgcctcatttcgtccagagcaaacttttctgcagcggctgcttgatagaggagccaccgacaactccacaattaatagaagtaatggctcagttgagtctggactcttcagccgaaaggcagacattgctatgactgtgacgtatctggtgcaaagtattgattatgagcgagctcgaaacgatgagcttgtgagtagtttacgaaatgatattgcttctattggtgtcaatgggtcgctcgcaaaggcagatgaagagctttatgcagaagcgaaaaaggtgcgaggttttgtggaggatcttcacttaaaacaccggcagctctctgctgaactggggacttgtggtgattttcaagcgaaggaccaagctgaggtgaagagattaaaaggcgagctggaggaagtttgtgctgatctagaagctaacaggcgccagttgactgctttccgctctcaggatgcgacgctctccggttcagccacacccagtgctacgccaactcggaaaatgtttgaagtaagggagggagatgcagagcaagggaaatttcctgaagagaattgtgaactggaaactggtttggaagaggctaagtcattggcagcccgaagccttacagagcttcaagaagctatgcataatcacttggatgatattcggaagatccagcaaatgcaggttagatttgctagtattttcatcatatcttttcggcaatatcagtcactggatgaacaagtccagtatttgaggactgaagttgagaagtatcgggccgtggtagacgagttacaggtagagcgtgtgtctcttgtgcgccaagagaaagaagttatattgaaagctgaggctggtgatgcagctcgtagggcaggcgccatttctgatgctcgggcagcagatttggagttaaagttgcagcagtgcatgtctgattgcgacactatgcgattaagaattgaagacgcaacccgggcttcaggtgtaaaagagtcggtagctgatctcaagaaggagagcactaatcttcatgaagatatgaatatgattcaaactcagttagacgatttcaaggaaaccggctcagctgtccattcactgcgagcaaagcttcactccttgcatttgattctggaaagaaaaacattagaaagtcggcttctcagtgaccagtatgctggccaagttcgagaactgaactttattcaggatgaggtatgtttgggtttgcgagatagcgagaaagaactaaagcttattttggatatgtacgacagggagttgagtgatccgagggaagttagagaattgcaacaagcggattgcagggctctagcggaagtaaaacgactgcagttggctctagacgagcacaatctagagcgtcgtgttaaagatgcaaatgaagcagaggctgcgtgtcagcagaaacttactgcggtggacgctgagattgctgagctgcgacaaaatctagatgtttcttacaaggttgctcaagatttaagggagagtctgcagaccaagaaagaggaagaggatacgtatataagtgaaatagacgatattacacaagcttacattgatatgcaaatccagaatcggaagttacttcaagaaatcatagaacgtgatgaatacaatgctcagttgatgtcagacagcctcaaagccaaacagctgcagacttcattacaagctgagaaacaagtgttgaatgcccggatgcaacatgtaattgctcgcgccgacctccacaaacagcacgttgctcgtatagaagatcaagccagagcatttattcatgaacatgggaaagctatagacgaaagtcgacatcaatcatcagcaatggaaagtgctaagcggaaagctgttgagatggagaaagagttggcttctgctaaatctgcactagccgctgcagacaaattgttagaggagcgtggtcagagattgctgaatgtgaatctgcaattaggaaaagagagctttaggttcgagaagcgaagggctcaagaggatttgaaaattgtaaacatgaagactgcacgccttcattctcttcacgatgtcggttccactgcagaacggttacaagaacaagttaatgattacagagctattttgcaatgcaatgtctgccacgatcgaaattttcaggctattatcactaaatgctaccatctattttgcatgccttgtattcaacggaatctggaatccaagcatcggaaatgtcctggttgcgggattccgttcgggcagaatgatgtccgatccgtgtacatataa

SEQ ID NO: 36 - DNA, 4959 bp, Vitis vinifera
atggggtctttggtaggacatgttttaccagggctagggttctttctaattgggttgtggcacctctttaaccatatcaagcttcatgctcaaaacccccactcctacactagtcacccatggttccccacctcaaaaataaggtatttggagctctttctgatcatgatagggtgctccatctccatatccatggagctcttcattggccctgttaggcaccaaccttttgatgtggatggcaccatcccatctaaccatctccacaactttgagcactcctccatctccatgaccttcctcgtttacgcggcatcagccattgcccttgatcgtgccggtgttaaggcgaggaatgacctgtctctgctccttgctggcatagcctttgggcagcagctcctgttgtttcaccttcattctacagatcatgttggcatggaaggacagtaccatatgcttctgcagattctcatatccttgtccctaacatctactctcatgggaataggccttcccaagagctttatactgagttttgttaggtctattagtatccttttccaagggctttggctgatggtcatgggggttatgctttggactccagcctatatccctaaagggtgcttcctccgctgggaagagggccaccaggtggcgcactgccatgatgacaagtcgctccaccgagctaaagcgctgataaacatagagttcagctggtatgttatcggtatggcgatgttttcagtgttcttctacttgtttttagttaaagtttatggcgaaaaggtcaagtactggtctatgatagggcacttttttccaggactagggttctttctcattgggttgtggcacctctttaatcacatcaagctccatgtccaaaaccccaaatccttcactatccacccatggttccccgcctcaaaaataaggtacttggagctccttctcatcatgatagggagctcctactacgtgttcactgagctcttccggcaccatcgctttgatccggatggcaccatcccatctccctatctacgtaactttgagcacgcctccatcgccataaccttcatcgtttacacctctttttccattgtccttgattttgttgccgctaaggctaagtatggcctgactcagctccttgctgccgtagccctcggccagcagttactcatgtttcgccttcactccaccgaccacgccggcctggaaggacaataccatttgtttctgcagatgctcacgcttgtctccatggcaactagtctcatggcaataggctttcccaagagctttatacttggtttttctaggtctctttgtatacttttccttggggtttggctgatggccacaggggttatgctttggactccaggctttatccctaaagggtgctctcttttatgggatgagggtggtcaccaggaggctcgctgccatgatgatgagtcgctccatcgtgctaaagcgctgataaacatagagttcagctggtatcttattgctatcatgatattttcagtgtccttttacttgtttttggttgacgcttatggaaaaaaggtcaagaacttgtcatgggagaagaaagaagagaaaggattctttctagctcacatggcgagttctatgatagggcacttttttccagggctagggttctttctcattgggttgtggcacctctttaatcacatcaagctccatgtccaaaactccaaatccttcactatccacccatggttccccgccccaaaaataaggtacttggagctccttctcgtcatgatagggagctcctaccacatgtccgcagaactcttccggcactatcgctttgatccggatggcaccatcccatctccctatcttcgtaactttgagcacgcctccatcggcataaccttcatcatttactcctcttctgccattgtccttgattttgttgccgctaaggctaagtatggcctgactcagctccttgctgccgtagccctcggccagcagttactcatgtttcgtcttcactccgccgaccacgctggcctggaaggacaataccatttgtttctgcagattctcacgcttgtctccacggcaactagtctcatggcaataggctttcccaagagctttatacttggtttttctaggtctctttgtataattttccttggggtttggctgatggccacaggggttatgctttggactccaggcttcatccctaaaggatgctctcttctctgggatgagggtcaccaggaggctcgctgccatgatgatgagtcgctccatcgtgctaaagcgctgataaacatagagttcagctggtatcttatcgctatcatgatattttcagtgtccttttacttgtttttggttgacgcttatggagacaaggttgatgcaacttacctccagtatcagaatcaaaaacttgttcagcagttagaggtgcagaagcatgagttgcatgaccttgaagacaaaatcaaagaattaaaagacaggcaaacttcatatgatgacatgttgattaccatgaaccaactctggagtcagttggttgatgatttaatcctacttggagtacgagcggggggaggtcaaaatgctatacaaaccttggaccatgcagaccattctcgaggtctgattccatcatgtcctgctgaggagatatttctctgtagactactagaaacagattctgttgaaagcaatgggaatgatggaattgttaaatatgttgaagaagcccttgctttgcgacattcttctactctggagttgattaaatccctggaagataccattgatgctcagagggtcaaaacagaaaacatagcacaggctttgcatggaaagctatctgcagaagatgctatcatccaattaagtaagattgatgatttgatgaaagaggaagctaacaatctgcgtgaggttattgatgctcttcacttaaagcataaggaatatgttgatgggattcaaacttatgttcacagccattcggtggaccaatctgaaattaaacgccttgcaggtgagctggaagagagcatggcagaacttgaagaaagtagaagaaagctagttaatctgaaaatgcaaaaggatgtagcatctgtggtgcataccccagttcagggtgctgtaaatggaagcttgtcccctgaaaagcatgcagacaggacaatgggtttcagagaattgaaggattcagttgaggaaacaaagatactggcagctgaccgtctttctgagctccatgaggcacaggaagataatctaatcttgtccaaacagttgcaagatctacagaatgaactgaaggatgacaaatatgtgtattcatctcgaccttatactttactcaatgatcaactccaacattggaatgctgaagcagaacgatacaaattactgacagattctctccaggctgacagggctcaggttgtgcgaagggagaaagaactgaatgctaaatcagaattggctgatgctgccaggagtgtcattgaaaatgactctaaaattgaagagctagaactccagctgcaaaaatgtcttattgaaaaaaatgatcttgaggttaaaatgaaagaagctcttcaagattcaggtagaaaagatattaaagcagagttccatgtaatggcctcggccttgtctaaagaaatgggaatgatggaatctcagttgaatcggtggaaggagacagctcatgaagcactttcattacgggaacaagtccaatcattgaaagctttgctaaataaaaagacaaatgaacaaaagtgcttagcagataaatgtgaggaacagatggtggaaatcaaatctctgaaggcactgattgagaagttgcaaaagggaaaattggaactgcagatcttcgtggatatgcatggacaagaaagttatgataacagggacttgatggaaatcaaagaatcagaacataaagctcacatgcaagctgaagttttgagaaatgctctagatgaacacagtctggaactgcgagtgaaggctgctaatgaagctgaggctgcttgccaacaaaggctttctgctgccgaagcagaaatagctgatttaagagccaaactggatgcttctgagagggatgttttggagcttaaggaggccattagaattaaagatgtggaagcagaagcttatatttccgaaattgagactattggtcaagcatatgaagatatgcagacacaaaaccaacatctgctgcagcaggtgactgagagggatgattacaatatcaagctggtttctgagagtgtgaagacaaagcaaatgcagagttttctactctcggagaagcaggctttagctaagcagcttcaacaagtcaacaatgcactagaatctttaaaaatgaggattgcccagagcgaagagcagatgaaagtttgtctggcagaggctttaaaatatactcaagaagacagacaccttgcagtcagcctggaaaccgcaaagtgggaattggctgatgctgagaaggaattgaagtggctgaaatctgctcttgcttcttccgagaaggaatatgagcagatccagcggaaaaaggaggaagttcaaatggaattggacaatgaaagaagtgagaggctgaagctggaagaagagctgaaggaattgaatagggagattgctgagatgagctctgagagtggggaggctgcaatacagaaactacaagatgaaatcaaggatggcaaggcaattctgaaatgcggtgtgtgttttgaccggccaaaggaggtcgtaatcgtgaagtgctatcatctgttctgcaatccatgcatccaaagaaatctagagatccggcatcgcaagtgcccagcttgtggaactgcatttgggcagaacgatgttcgatttgtaaagatatga

SEQ ID NO: 37 - DNA, 2637 bp, Arabidopsis thaliana
atggcgagcacaggcgagcctgaccgtaaaaggcgtcactttagctccatatcaccttctgaagctgcagccgccgtaaagaaacagcctttcttttggccctcctccgaggacaagcttgatactgcagttcttcagttccaaaatcttaagctatcacaaaagctagaggctcagcaggttgagtgttctattcttgaggataaactctctcagatcaaggaaaaacaattaccatacaactccagtttgaagactgtccataagtcttgggaaaagcttacagcttcagtggaatcatgctctgttcgtgtgagtgattcaagcagcggagctcataggtttgtaaacaaggaggatgggtcttctccagccgtgaaaaacgatttcatcaaccggctacttgaaactggtgctactgagagctcctcatccaatatctgctcgaatcagatggaagaaaatggagtgaatacgtcaagccagatgacgcaaaccttgtataatctagtagccgcgacagaggatttgaggtgtctgaaggatgaattatatcccacagttctcagaaccaatcttggtaaagatttgtgcggtcagctagctctgagtgagttggaatcagaaattaaaagtttcagaggggatctagatgatgtacttgtgaagttcaaatcactttctagagaattgcagagtcatcgcgatgctgatgctaaagttagagtagacctcaaacgaataagaggggagctagaggatgaggttgtggagcttcagcagtgtaatggtgacttgtcagcattgagagcagaaagggatgcaacagctggggcgtttttcccagtgttgagtcttggaaataagcttgctaccagtgatcgggagagggataaacaaagggatctgcaagacatggaaacagttctgaaagagttaacggtcctggcttcaggcaggctacaacagctaaaaaatcttcatgaggagaggacaaagatgcttggaaaaatgagtaatttacagaacaagtcaaagtctgtgaggtgcatctcatcttctcaagcctgcctttctttgaaagaccagctagaaaaatccaaagaagcagttttccagtatatggctttacttgagaaactgcaggttgaaaaagatagtatagtctggaaggaaagggagataaatataaaaaatgaactaggtgatgtttctcgaaagacgtctgctgttactgattctagaatggcttctttggattcggagatacagaaacaactggatgaaaaaatgcgaatcaagactaggctgggaaatatatcaagagagcgaggtagaaaagaaatctttgcagatatgaaggcattaatttcttcgttccccgaggaaatgagttccatgcgtagtcaattaaacaattataaagagactgctggaggtattcattctctgcgggctgatgtccagtccctctctggggttctatgtaggaagacaaaagagtatgaagcattgcaattgagatcagctgattatgcttctcagttaggtgacctgaatgctacggtttgtgatttgaagaacagtcatgaggagttaaagttgtttctggacatgtataaacgtgagtccactgatgcgagggacatagctgaagccaaggaacaggagtacagggcttgggctcatgttcagagtttgaaatcatcccttgatgagcaaaatctggagttgcgcgttaaggcagcaaatgaagctgaagccgtttcccaacaaatgttggctgctgcggaagcagagattgctgatttaaggcagaaaatggatgattgtaaaagggatgtcgccaagcattctgatatcttgaaatctaaacatgaagaacatggaacatatctttctgaaatacagacaattggaagtgcctatgaggacattgtaccgcaaaaccaacagcttttgcttcaagttacagagagggatgactataacatcaagcttttcttggaaggcataacttctaggcagatgcaagatactctgcttatcgataaatacatcatggataaggatatacagcaaggcagtgcatatgccagtttcctatccaagaaatcatcaagaattgaagatcagttgaggttctgcacagatcagtttcagaaactagcggaagataaatatcaaaagtctgtttctcttgaaaatctgcaaaagaaacgtgcagacatcgggaatggcttggaacaagctaggtcaaggctggaggagtcccattctaaagttgagcaaagtcggctggattatggggcattagaactggaactggagattgaaaggttcaataggagaaggatagaggaggaaatggaaatagccaaaaagaaagtttctcgtcttcggtctctcatagaaggatcatcggccattcaaaagctccgacaagaactcagtgaatttaaagaaattctgaagtgtaaggcctgcaacgatcgcccaaaagaggtggtgattacgaagtgctaccatttgttctgcaacccatgtgtgcaaaagctcacaggaactcgacaaaagaagtgtccaacatgctcagcaagttttggaccaaatgatattaaacctatctacatatga

SEQ ID NO: 38 - DNA, 2700 bp, Arabidopsis thaliana
atggagaatcaggaatcggacgagccgatgcagaagaagcctcatcttttagactccgtttctccgaattccatggctcgtaactcttcaccttctcaccctatagctaaaagtgtaagctttttcgactgtgacttctcgcttctctgtttaaggctcgttgattatgaaattgatgttgatgccactgttctacagttacagaatcagaaactggttcagcaattagacctgcagaagaaacagctgtacgatgttgaaagcaagatccaagagttgcagctcaaccaaacgtcttatgatgatgaacttatatcagtgaaccagctttggaatcagttggtagatgacctgattttgcttggtgttcgtgccggggctaatcaagaggctctaaactacttggacattgtagataaaaagcgagttccaccatgcgctgctgatgaaacgtttctatgtagacttctgcaagtagattccttagatactagtaagagtgatgaggtagtaagaaaggttgaagaagctcttgctttgcgtcattcctctacaatggagttgatgggactctttgagaacaccattgatacacagaagacgaaagctgaaagcatttcacaaagtttacatgctgtaaaatcgacagaagatgccaccatccagttatctagcattaatgatttgatgaaagaggagtccaaaaacttgcgtgagatgattgatgctttacatgtgaggcacaaagaacattccgagcagattcaggcgtacataagcagccattcaacagatcaatccgagcttaaacaccttaaaggtcaattggaagagatcaaggctgagcttgaagaaaatagaagaaaattgataactctgaaaatgcagaaggatgctgcatgtgaaggtcatgtaacatcaccggcaatagcaaatggaagtctttctcctgagaagcctgtagataaaacgaagttgcgtgaattgaaggactccattgatgagataaagataatggcagaaggtcgtctgtctgagcttcaagcttcacaagagtataatctttccttgtcaagacaatgtcaagatattgagaatgaactaaaggatgaccagtatatatactcgtctagactgtatagtttgatcaatgatcgaattcatcactggaatgctgaactggaccggtacaaaattctgactgaggccattcaggctgaaaggtcctttgtaatgagacgggataaggaactaaatctgagggcagaatctctagaggcagccaaccataagactaccactgttggttctagaattgaagtgctggaaaagaagctgcagagttgtataattgaaaagaatggattagagcttgaaacggaagaagctattcaagattctgaacggcaagatattaaaagcgagtttattgcaatggcatcaaccttatctaaagagatggaaatgatggaagcacagttgaaacggtggaaggacactgcacaagatgctctttacctgcgtgaacaagctcaatcgttgagagtttcgttaagtaacaaggcagacgaacagaagggtttggaggataaatgtgctaaacagatggcggaaattaaatctctcaaggctctaattgagaaactactcaaagaaaaactacagctgcaaaatctagcaagcatctgtacgcgtgaatgtaatgatgacaggggactggcagaaatcaaggattcacaacggaaagcccaagctcaggctgaagagctgaaaaacgttttggatgaacactttcttgaattgagagtgaaagcggctcatgagactgagagtgcttgccaagaaaggcttgctaccgccaaggctgaaattgctgaattgaggactcagttagatctttctgagagggaggttttggaacttaaggagggtattaaagttaaagagcaggaggcagaggcatccattgctgaaatggagactataggtcaagcctatgaagacatgcagacacagaaccaacatttgttgcagcaggtggctgagcgggacgattataatatcaagcttgtttccgaaagtgtcaagacaaagcatgcttacaacactcacttatctgagaagcaagtaatggaaaagcagctccatcaggttaatgcatccgtagagaattttaaagcaaggattgcacataatgaggaacagatgaaaggctgtttttctgaggcttataaattgattcaagaagatcgtcacctcgttatcagcctcgaaaccaccaaatgggaagtagctgatgctgacaaggaattcagatggctcaagtcggccgtgtcttcatccgaaaaggaatatgaacagatcagtaggaggacagacgacatcaaactggaactggatgatgaaagggagaagaagaagcttgaggaagagcttatggagttgaacaaagagcttgaagagttgggttctgagagtgtagaagctgcaattgtgaggctccaggaagaagttaagaattgcaaaaacatcctcaaatgtggtgtatgttttgatcggcctaaagaggtggtaattgtgaaatgttatcatctgttctgccagcaatgcatccaacgtagcttagagatccgacaccggaaatgtccaggctgcggtaccgcctttggccagaatgacgtccggcttgtcaaaatgtaa

SEQ ID NO: 39 - DNA, 1794 bp, Medicago truncatula
atgtatcgactatgtatacttctcacatacccaactctttttagagttgctaccgcatactggataccttaccatgtgccaaaacgaattgtgaaccagtgctggactggccagaaaatgcaaaaggtgaccggaaaacgcgggtggagtgattccgcaatggaaggaaagctgtcacacgaaaacacattgaagaatttgaagtgtattacctcttcccatgcattccaattggttagagatcagacagaaaaatcaaaatctgaagtgcaggagtatcaggccttatatgagaaactacaggctgagaaggatagtcttacatggagggagagggagtggtacattaaaaatgatttagctgatctttttcaaagatctgtggaagtttctgatcttaaagtggctgatatacgcactgagttacggaaaacaatagagcaaagagatgtgattgaaaataagctgaaagaggaagcaagagaaccaggaaggaaagaaattattgctgaatttaaatctcttctttcttcatttcctgaggaaatggggtccatgcaaagccaactaagtaagtataaagaatcagcttcagatatccattctttgcgtgcagatgtgcattctatttccagtattctcgatcagaaggtaaaagaatgtgatgcattatctgttaggtctgctggtcaacttgctgagataaatagactgcttgctgtggttcaagatttacgagttactgaggatgagatgaagttgatactgcgaatgtttagacgcgagaccattgattcaagggatgtcatggaagcaagggaagcagaatacatagcatgggcacatgttcaaacattgaaatcatctcttgatgagcacaatttagaacttcgagttaagacagcaaatgaatcagaagccagatcgcagcaaaaacttgctgcggctgaagctgagattgcagacatgagacataacttagatgattctaaaagggcgacatgtaaacagtctgatgtcatgagatctaaaaatgaagaaaatgaagcctacttatctgaaatagagactattggacaagcatatgatgacatgcaaacccaaaaccaacatctgttgcatcagattactgagagagatgactacaatattaagcttgttttagaaggtgtaagggctagacaaaagcaggattcttttatcatggagatgcgattgatggaacaagagatgcagcaatcaaatgtatctctgaatttatacaatacaaaagctgcaaaaattgaagaccagatgagattttgctcagatcagattcaaaaacttgtggacaataaacttcaaagttctgtcgatttggaaaatacacaaagaaggctgtcagatattagaccgtcatcgcaacaggttaggaatacagtggtggaagtgcaatctaaaataaccagtagtcgggtgactcatatggagttactagtagatcttgagaaagaaaggtttgccaaaaaaagagtagagaaagatctagaggttgctaggagaaacttttcacatcttaaagcacaagatgaagattcctctgaaactgataagcttcaacaggaactgggggagtacagggatattgtcaagtgcagtatctgtcgagacaggacaaaagaggtggtaattacaaaatgctatcacttgttctgcaactcatgtatccagaaaattgctgggagccggcagcgcaaatgtccacaatgtggtgcatgctttggggctaatgatgttaagccggtttatttgtaa

SEQ ID NO: 40 - DNA, 2652 bp, Oryza sativa
atggggagcacgggggagcccgaccggaagcggcggctcagtagctccgtcgcgcccggcggcggggcccctgtttctcctgccaagcggctggcggttgcacccacctccgaagataagaagctcgattttactgtactcaaatacaaaaaccaaaagctctcagagcaactagaagcccacaagtttgagtatcgtgctcttgaaaataaattcgctgggctaaaagagaagcagaggactcataatgagacactttccttggtcaacagttcttgggaacaacttgtggcagacctgaagtcaagatctttttgcaaaagtggatctcctaattccagccctggttcagggcacaacaatgtacaaaaggatggtacttgtgcacccatagagagggacactcttagaagtcttgtggaatctggtgcaactgaaagttcaggttgtttgcctggttgccacttgggaagtgatgcccctccattacatctatccacagctaatgctcttggggatatcttttttccatcaagtgatcttttgcaagcaaatgaggagtgtgctttggctgctctcactaaattaccagaaaatgaccgcagtaagcaactacagagtactagtagcaacctgttgtccagcctcaataatgtcgtacaagcattaagtaatcttcagttgaagcacaagcagttagcagaggattatcaaaatcaaagagattccagtgcccgaaaaagagctgaacatagacgtctaaaagaggagttggccagtgctgcttctgagttggaagaaactaactacaaactggcagcacttaaagctcaaagagataatacacaaggagctcgaatcccatatcctacattaggaaacaaaaatatgcctgaagataaggaattgatttcaaagcggttggtggaaattaagagattacatgaagagagaattgaaattttgaacaaaatagcaacttttcagaatatcttgatggatttcaagagcattcgttcttcaaaagcttttcagcttgttaatgatcgacttcagaagtcacaagcagaattggatcactaccagacattattagagaaattacaggttgataaggataagtttgtgtggcaagaaaggcaatttaatttgaaagttgatctggctgagattcctgagagggtttctacatattgtcggaatcaagttattacaaaatttaaagctttagtgtcatcgataccaagggaaatgggcgcgatgcagagtgaaatgaccaaacacaaggaggcttccttggagttgaattctttgcgagcagaagtccattcactttctcgcattctgtccagaaaggaacgtgataatgaagaagcatcatgcagatctgcccgtgcgggatctgatataacacaacttcaatcagtgatttctgatctgaagcaaactaataaggagcttaagttgttcgcggatatgtataagcgtgaatccactgattccagggaaataatggaatccagagatagggaattccttgaatgggctcatgttcatgccctgaaatcatctcttgatgaaagtaagctagagcagcgtgttaaggctgccaatgaagctgaagcaatcacacagcagaggctagcaactgcagaagctgagattgctgaatcagggcagaagcttgggacttctagaaagtacagaattatgcttctgaacattgtttctcttagaactgttgaagtaggggtcacttctcttttaggggatctagtcagtttatcccatatgctgaagtctaaacaggaagaatgtgaagcttacagagtggaggtcgagtgtatcgggcaagcatatgaggacatacaggcacaaaaccaacaattgctacagcagattattgaaagagatgatgataataccaaggatgttagatttggttatattgttaatttgattgttccggagactcagtacttcattgaaaagctgtttacttgcgttaagttgatttttatggagggtgttaaagcaaaacagacacaagatgctttgcatttggaaacatattctttgcgcagaaacttgcagcaggaaagctctttgatggatctgtacaaccagaaaattgtttccttagaagatcagcttaaaatgtggtctgatcgggttgggaaacttcaagaggatggatggcaacaatctgtttcattgagtaattaccaaagaaagctggttgatgtgcacagagatgctcaaaagcttatgcaatcattggatggaatacaagcgaatgttggaagcagtcgtttggaagtcgctgatctgcttatagaacttgagaaagagaggtttagtaagaagagaatagaggatgatttggaggttatgtcaaggaaagctagctctcttagagccaaggcacgtgaatcagcagtcctggaaaagcttcgtcatgaggtcaaggagtatagggggatattgaagtgtggtatctgccatgataggcagaaggaggttgtgattaccaagtgctaccatctcttctgcaatcagtgcatacagaagtcccttgggaaccgacagaggagatgtccttcatgtagcttgagttttggggctaatgacgtgaaacctatctacatatga

SEQ ID NO: 41 - DNA, 2466 bp, Oryza sativa
atgcgtgcattggaaggcaagttcaaggagctgagggatgagcaatgttcttacgacaatacattgatttgtttgaataaaatgtggaatcagctgattgatgatttagtgctgcttggggttcgagctggtggggatttaaacggtttgcaagcgcttgatcatgaagagatgtcagaagaatctcttgagtcatgtccttctgaggagatatttctcttcagactcttgaattccaggaatttcagaaataatgatgacagtagcctgtcaaaattagttgaggaagctcttgccttgcgctattcaacaacagttactctgatgaagtccctgcaagaggcttttgctgtacagcaggctagaagtgaatctttatcattagctttaaatggacagaactccagtgaagacgttattgtggcccttgaaaaccataatgattacttgaaagaagtggttgacaatttacgtcaagctgtgtctatcatcaacaggaagcacgaaaagtatctggatgagattgaggctttcaaaaacaatcaatcaagagaactacatgaagtaaagtgtctttcaggtgagctagaggaaagcatggcagagcttgaggaaagccgtcgaaagttggctgttctccagttgcaaacgggtggaggctcactgatgaacacatctgctcctaacggtgtgaacggtagtgtttcaactgataaatcttcagacaagggtatgggctggcgagatctgaaagatgctgttgaggaggctaagactcttgctgcaaaccgcctatttgaactccatgagactcaagaggataatctgatactatccaagcagttggaagatattcaggatcaattaaaagatgagaactatattgttacatcaaaaccatatacgattctcagtgaccagttacaccatctgaatgctgagatagagcgatacagggggttagttgaagtgctacagaatgaaaaggaccagctcatgcaaaaggaagaagaaatgcttgcaaaggcagaatcagtggacgctgttcaacaatccattaccacttacaaggccaaaattgaggacctggaacatgaaatccagaaacttatggctgaaaagaatgatcttgagatcaaggctgaggaagccttgcaagattcagggaaaaaagacttcaaggacgagattcatgttatggctgcatcactctccaaagagatggaattgttggacaatcaaatgaatagatccaaggatgcggcttctgaagcacttgcactacgtgaggaagctgactatttaagaactttgctagctaagaagattgatgaacaaaaggagatatctgatagatacaacacacaagtcaccgagatcaaatccctcaaagcattgattgagacactggaccaggaaaagcaggagttacaatttatagtggatatgctcggtaaagaatgttctgagtcgagggcaatttcagagattgaagaatcagaaaaccgagctcgcaagcaagctgaatatttgagaaaatgtttagaagagcataatcttgaacttcgagtaaaagcagcaaatgaagcggaaactgcatgccaacaaaggctttcaattgctgaagcagaactggaagacttaagggccaaagtggatgcatcggaaagagatgttatgaaactcaaggagtcaataagaattaaagaagctgaagtagatggccatatttctgaaattgagacaattggtcaagcatatgaagacatgcaaacccaaaatcagcaccttcttcaacaggttgctgatagagatgattttaacataaagctagtatcagatagtgtaaagatgaagcaagcctatggttcccttcttgctgaaaagaatatgctacagaagcaacttcagcatgtcaacagttcactggagtcatctaaactaaaaatcaccagtggtgaagagcagatgaagacctatgtagcacaagctatgaaatcttcttcagagaataggcatcttgcaattagccttgaaaggactatgctggaggtatcagatgcagagaaggagctcaagtggcttcggtccgctactggatctgctgagaaagaatatgagataaatcagaaaaaaatagctgagctaaaaatggagctagagcgtgagagaaatgagaggataaagcttgaggaagaatacgaagaggtgaaaaacgaagtcagtgagctaacctcagaaactgaagagactactatacagaagctccaagatgaaataaaagaatgcaaggctattctcaagtgtggggtgtgcttcgaccggccgaaagaggtcgtgatcaccaaatgcttccacttattctgctcgccatgtatccagaggaaccttgagatccgccaccgcaaatgcccaggttgtggcaccccctttggacagagtgacgttcgggaggtgaagatctga

SEQ ID NO: 42 - DNA, 2103 bp, Saccharomyces cerevisiae
ttacaagtgcactgtcaataaatcattggaactgaatgctttgttgcatgtagggcattttctcattctcgctgccaatcgttccttacagcaattctcacaaaagacatggccacaggttttaatagccatgtttttccaatttttagaacacagggaacaataaacaagtgtacggaaatttgctagttcttctacgagtgcttcatcgctcgagcccttatttttgttgttaccacggaacaatgtatcatgtagtttttcacacttggattctagatgagatgccttctgcttgaagtgcttcaattctatttctgtatcatttaatttagtttctagatgcgtcatatctgcaatgcttttgttactttcttcttgtagcttttctaatgaccttttcagtttagtggatgtattatttaaatcaattatttttagtgtctctgttttactggaatcaattaacctgcgttcattattttgagaaagatccagttgtttatgtaaatttcctattttttgctgtagcaatctatcagagtcctttaactgtagaataagctcatttgatttactgaggcttttagaaagagttttgatttcaattaaaattgaatctttggacctcatcgcggcaaaatatttctgatcagccttagttttttctacggtaagcttggatataacagattcgtgattaataatctcagagtactttttatgagttaagtcggataactctctaaaacccttctctaagtcttgaatttcctttattaatgcatcttgagtcgacgaggattttgtatcgtttgatctttgatcaatttttgtccattgctccttcaaaatatcaattgcatgttgtaaatcgctcaacacttcagtcttggatttttcagcttccaaaatggcgattttgcttagtaaatcatcacgagccgttcttattcttacaacgtccttttccaatgaactgttcatttctactagggagtcgagacttttctggaattcttctcggaccttcttcgtatatatttctttctctttggctaaaacttgaaattttgataaaaaggaactattgatctcagataattctgcgttttgttcagtcaaatgttgaatttttgctaacagggactcatggtcatatgacttgaaatctgggtcttggtctgctgctgctatctgttgcttttttaaattggatacctcagaacgtgttttgatgagctcttcctcgttttcccttctgatattttcaaggtcttttatagtggaactcaaggagtttatctctgcccgtaaatcagaaaatttcagatccaattctaatttttcattctcagcatcttcttttcgttcatcctccgcctgcacaagttcatcacctttctcggattttttggatgtattatcaccattaattgcagaggagtctttatttccagattttatattgttttcattagattctttttcatcttcccgtaattcctttacagcatcagtcttatcttccttaaaaacacgttttatagtaaaggattcatctctatcatacttgcgaattatatttgtataatattccttcaaagcagaaatctcctctgtcaattgcgaattttcataaaagagctcctctttacttttccgcaagttttttaactccgttgttaattcttgaatatgatccgaagcattactattagtattactatctgtcgtgtttggcttcccatatttagtcagtagcttcatgaaagaatcactgcgctgaactatcaacgtctcatcgccttgggctatttccctacatagttgcttctcgttggcgtctgtgcagaatgtttcgataaacctagctaaagttactatcagcgccataatatttgccaacttgcgggaaacatctatgcactcccttcttgaaagttcatattgctttcgcaaggcttcaaagtcgactcttcgacgatttatacatctaaacaaagcttctttttgaaacgctatcacatcagattgagtaagcggttcactaggatcgcttaattctagcttgatcttcttagtagcaggctcggccgtcat

SEQ ID NO: 43 - DNA, 2043 bp, Schizosaccharomyces pombe
atgtatcagaatggtaaaccagatgcccccacaatcttaggccagaaaagagaacttgaagatgtagaaatacaagatgatgatattcaggaagtctctaaagaagacttattaaaggatgtaagagtgaggagcattcaatttgatgagttagaaagtaaaatagagggacttcaaaatttagcagaagagaaattaaaagttttagctactttggtctcttggtggcctgaaatacttcagcagtttagcgttgtgtttcaaggcaatgagctgaaggacttcgagagtgaaggtgttttttcgattttggagaaattcccggagctttcatacttcaatgacgctgtgaaaaataataaaactaaagccttgagcatcattcaaaaactcttgtctactgttgactcaagcacaaattcggtctccagagatcctttttcagttttatcaattgatgactctgcccttactgagaaattaaacaccattaatttggatattgacaagattttagatgaattggataccactcggtctcagcttcattcaattataaaactaccagatcgctcgtctagttttactttgcaatgcattaatgaatcagtgagaccccagtctactaaagtgaaagaggaagcaaccacctcctctaaggggaaagatgaagaaaagaaagttagcacggttgaacaacgtactcaactgcaacaattatccaggcttcaagaccaacaaaatggtttaatggagtctcgctcacaaagccttaaaattttggattcgaacgttaatgaaatggataaattaattatggaacgagaaaacgcattaaacaacgtcgaaactacaaacttgaaaaaatactcttcctttttagcacttaaagaagctgtttctatgacatctgagcagttacgcgtattagagcacttattgtccgaatgttctcacgaaataaatgtattgtcgcaacagtcaaagaattttaacggtgtttttgaatcttcctatcagccgttaataaacgatcttgatcatcaaatatctgttatgcaaaacgatgaaaaaagaattaataacgcaaagactgaattaagcttatcccttgaaaagaagttggaagctaaaaagcaaaaagagaaggtctacaaagacaagttagatgaacttgcgaatttagagacaatggtattggaaaagaaaaaagcggtggctacccgtgaagctgcaaacaaaatccggctcgtagaccttaacgatttggagttacaaaaagatctgtcaacttacctttctaaagagttggcttctactgaaaaagcatttaggttggtaaaacagcaaactgtgaaaagtagccactcccattatcaagaattgataaccaaatttagtgtcgaaaaggaaaaggcggagcaaaaatattttctgaccatgaagtctacagatagtcttcatgctgaagtaaagttactgcgccagaagtaccagaagaccaacgaaattatctcaaaaatgttaaatagccaagacactgctgtccatagaataatagagtttgaagatcagctagcccgtctatcatcggttcgaaataactctataaaacaatcaacaacgtttcaagtcaaaaagtcatctcaaaaatcaactattcaaaacctggaagaaaaggtgtcttatttacagcaatttatggataaaaataatgctacattaacagaccttgaatttcaatgctcagatttatcatcttctatagatatactttccaagcaagatgaagagcatgaaaaagagaagcgaaagttaaaggatactggggtatcaacgtcagctgaagagttaaaaacttttagggccatgtgtaagtgttcagtttgtaacttcgagcgctggaaagatcgaattatttctctctgtggtcatggcttttgttaccaatgcatacaaaaacggattgaaacacggcaacgcagatgcccgatttgcggtcgtggatttggtgcttctgatgttattccgatacatctttga

SEQ ID NO: 44 - DNA, 2505 bp, Caenorhabditis elegans
atgatgaaaagaagtaatgaaggtataggaggagaaaattatgcaagtagcccgagtgacgatggacaacaaaaacgacgcaaaattcaattcgaaccggtccgaatgcccgctgttagcaacgtgaacgatataagagctcgtgccgtagtttatcagacatctaaattaaagcagcaattgttgtacaaaaataagcgaatagccgaattggaaaaagaaaatgaacggtccaagaggcggcagcagacagacgaaagcaactttctgaaggtttataatatgttctcagatattgagaaatacatatgtacacaaactaagaatgagtttggagaatacatcggaggagacactgcaccaactggtatagacgttcttggaatgactaatgaaacatataacaagttctttgatcaggcaaagcagaatttacggaatgcattcgtatcgtatgctaaagcgcgccacgatcgggctcacgaatccaccattttcatcgataaactaaaaacattgatcgattctcctaccttcaatccaaatggtgtccataaggagcttacagccaaagcagcaagtttagctatacaaaatgaaaagcttcaatccgaagttaccaaagttcaaagcgattgttacaatttggaacggaaaaagcgtattctaacggataagctttctgtacaagagaacagagttcaagaattagaacatcaattggaagatgcccgatttgaaactgacaaacatatgcgtcttgctaacaaatttgagtacaaactagccaccctcgtctcggagggacagtctggagggaacggaggggcgacaccgtcttcgtcgggtacaacaaatgctactgagaagaagatatcagctccagatattccaccaagtgaaacagctgcaaaagaaatcgaaaatctgcgtcttgaacgagatgaacaggaatccattgcatcacgacgccttcaagatctcgaggagatgaataaaaaagttcaaacattaacacaggaaaatagcaagctaagactagagacacaaactttcttctctgtggattcaattgtcaactcggaggaatacaagaatcttaaaaagtactactcattagcaattaaagaatacgagcgagtcagcaaagatcttgaagatatcacaacagaacgtgatgctttccgcagtgcaaaggaagctcgtgcaatgctaatgtctgaagaacatcagaagacgctgaaggaaattcaatgtcaatcggatattcacaattctttctacaaagtatctcatgacagtgaagttctacgctgcgaattcgaaactgttaaggaagaatataataagacggtgaagcaaagcgagtgggatgaaatgaaagcaactttgaatactctacgatctatgaatagatcgttaaaatcagagaaaattcgtttgcgcgaaaaggataagcaatctcaaaaagatatcaacactctcaagtctgagttaacttcactgaaagaagcccaggataaatgtctacttgttcctcttgaagacgttagtaatgctccaccggaagatgttaataaaattcgtcaagaatacgaatctttgtgtaaagaagtaaaacgactgggagcaatggaaaaacaggagaagcagaaacaagtcgaaaaagaagtcaatcgtcaaattgctgataaattgtccgaattggagactcttcgtaagaccaatgaaatgctgactaatgacgaagaatgcatatctgatgagttagaagccattggaacagctgtagaagaagaacaagaacggaatgctcaactgtacattgagaagcgggaacaggaggatcgaaatctgaaaatgatgaatgatcgaatgattcagaatcagacatttaatcgattgcgtgaaaaattgtcttgtttggaaagtaaagcacaaacagatgctcaaatagcaaaaatgcacgaatttgagaagaaagcaaatgaagagttggtaactaaactgtcggaatcagttcagttcaaatctgccgaattaacacgtctcacaaacttgatggaacaacatagaaagaacattcaagaagttggaatgtcacgagacgaaaaccaaattaaagcggatcgatgtgaaggtcaaatgaagcaaattcaagaattatacgctgccaaggcacgtgaaatcgaagattttaaattcaagagacaacgtgctgaagaggaacttgagacgcttcgaattaaatatgaacgagtaaaacgaaatgagtctgtaccggctcaaagtggtgatcaagtcctcgaggaagcgaatcgacaaatgaaagaaacactgacttgtccatcatgtaaaacgaggccaaaggattgtattatgctcaaatgctatcatttattctgtgaaacttgcattaagactatgtacgacactcgtcaacggaaatgcccgaaatgcaacagcaacttcggagccaatgacttccatcgtattttcatctag

SEQ ID NO: 45 - DNA, 3135 bp, Drosophila melanogaster
atgtcgaaacggagcgccgacgacgccaccggcagcagctgcttggtggccgccgcagccgccggccagccgcccatcaagaaggtgcacttcgagccccatctgattgggccggtgtccacgctggaggagatggacatcaaggtgctggaattccagaacaagaagctagcacagcgcatcgaacagcggatgcgaacggaggcggagctgcgacatcgaatcgagcagctggaaaagcggcaaacgcaggacgacgccgttctaaacgtggtcaatcggtattggaatcagctgaacgaggacatacgagtcctgctgcagcgcttcgatgccgagacggccgacgaactggagaaccggaatgagaacgaggtgaccacctcgtttctcgcccaactgtccacctgggacaaggaggagctggacgagaagctggccaaccgcgtccaagtgtccaaaagggcggtcgccaagatcgtacaggttattgataggttaatgcaacgcaatgaaaagataactcatgtcttgaaaggtgatagtctggcttcagctggctccggttcaggagcgggagctggcggcgaggaggagcagcagcaggccagcggcgatgcggagaccacaacgtcatcggccggtgtccatgcgctagaggaaaccctgaagcaaacgcacatcgagatcatgagcgaaaatcacaagctgcagaatctgaatacctcgctgcacgagaagttccacaccatgtcgctgaagatgaaggagtaccaggacgctcataccgccaaggagacggagaacgccgaactgaagaaccagatagacgaactgcaatatgacctagagaagatccattgccggaatgataagctggagaaccacttggccgaggctattgaaaagctgaaggcctaccaccagatttacggtgatcccaataagagcactaatagtgccaagacaccaactaccacaggcagcggcggcgccaccaccagcgttaatagccagctattggaggagctgcaaaaggagctggaggagtaccgcgaactggccaacaaccgactgcaggagctggataagcttcacgccacgcatcgcgaaaccctgaaggaggtggagaagcttaaaatggatatacgacagttgccggaatcggtaattgtggaaaccacggagtacaagtgcctgcagagccagttttccgtgctctacaacgagtccatgcagataaagaccatgctggacgagacccgaaaccagcttcaaacgagcaagaaccagcatctgcgacaaatcgaagtgatggagagcgaggaacttattgcccagaagaaggtgcgcagcgagatgatccagatggaggacgttttagccctcatccgaaaggagtacgaaacgctacgcattgagttcgagcagaacatggcagccaacgagcagacggcacccatcaatcgcgagatgcgccacctgatcacctctctacaaaaccacaatggccaactgaagggtgaggtgcagcgctacaagcgaaagtacaaggacacgtccacggacaacttgaagctgcgtcaggagctggccgatgcactagctacactcgaaggcaacaagttgcaggcggcgactggtgcggctggcgaagaaatcaagcaggagaactcaacaggtgtgaaggaggagaactccaacaacgtttccgccagtggacaaacaaaccaaacaaattccggcaacgataccaacgtagccatcaaggaggagaaccatatctcggctgaagatgaagctgatgacgaggccagtggtaaggacgtaaaagacggcatcaagcaggagaagctcagttctggagacgcggcggcagctgagaagaaggattcccctggacccggaaactcaacaagttctgcgaccaattctgttcccgtcaaaaacgaaaaggattccaaggatggtgtcaagggcaaggatgtgaaggcagtggaaagtgaaacggtgcgcgatctgaaggcgcaactaaaaaaagcactgaacgaccagaaagaaatgaaactcctgctggatatgtacaaaggcgtatcgaaggatcagcgcgacaaggtccagttgatggccaccgaaaagaaactgcgctccgagatcgaggagctccgccagcagctgaagaagctgcaggaaagcaagcgcgaggaacgcaagaagctggccgacgaggaggcgttacgtaagattaagcaattggaggagcagaagtacgagctgcaaaaacagatggccaaccacaagccaacggataattcttggggcagtggagcccccggcacagcgaactacacgcgaccgtttgttggttcccacgaagaggaggcactgctgaacgagatggaggttaccggccaggcgttcgaggacatgcaggagcagaactcccggctcatacaacagctgcgtgagaaggacgatgcgaactttaagctaatgtcggagcgcatcaaggccaaccagctgcacaaacttctgagagaggaaaagacggtgctggaggatcagatggcaacggcgaccacgcaaatcgaagccatgcacattgtgctgcgaaagctggaggagaaggaacgcagcctgcaggccaccgtcgcgtcgattgagaaagagttgatgctgcggcagcaagcaatggagatgcacaaacgcaaggcgattgaatcggcgcaatcggcagcggacctcaagctgcatctggaaaagtatcacgcgcaaatgaaggaggcgcagcaagtggtggcggagaagaccagttcgctggaggcggaggcctacaagaccaagcggctgcaggaggagctggcgcagtttaaacgcaaggcggagcgcatgaagaagatggaaatgtcgggcaccaccatcgacgaggtgatgattgaggagatccgcgaatacaaagaaacgctcacgtgtccctcgtgcaaggtgaagcggaaggatgctgtcctgtcaaagtgtttccacgtcttctgctacgactgcctgcgcactagatatgaaacgcggcagcggaagtgtcccaaatgcaactgcgccttcggcgccaacgattatcataggctatatctgcagtag

SEQ ID NO: 46 - DNA, 2241 bp, Homo sapiens
atgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaagagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttga

SEQ ID NO: 47 - DNA, 3006 bp, Homo sapiens
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctga

SEQ ID NO: 48 - DNA, 2396 bp, Medicago truncatula
atgtatcgactatgtatacttctcacatacccaactctttttagagttgctaccgcatactggataccttaccatgtgccaaaacgaattgtgaaccagaacacattgaagaatttgaagtgtattacctcttcccatgcattccaattggttagagatcagacagaaaaatcaaaatctgaagtgcaggagtatcaggccttatatgagaaactacaggctgagaaggatagtcttacatggagggagagggagtggtacattaaaaatgatttagctgatctttttcaaagatctgtggaagtttctgatcttaaagtggctgatatacgcactgagttacggaaaacaatagagcaaagagatgtgattgaaaataagctgaaagaggaagcaagagaaccaggaaggaaagaaattattgctgaatttaaatctcttctttcttcatttcctgaggaaatggggtccatgcaaagccaactaagtaagtataaagaatcagcttcagatatccattctttgcgtgcagatgtgcattctatttccagtattctcgatcagaaggtaaaagaatgtgatgcattatctgttaggtctgctggtcaacttgctgagataaatagactgcttgctgtggttcaagatttacgagttactgaggatgagatgaagttgatactgcgaatgtttagacgcgagaccattgattcaagagatctttgtcgcagggatgtcatggaagcaagggaagcagaatacatagcatgggcacatgttcaaacattgaaatcatctcttgatgagcacaatttagaacttcgagttaagacagcaaatgaatcagaagccagatcgcagcaaaaacttgctgcggctgaagctgagattgcagacatgagacataacttagatgattctaaaagggcgacatgtaaacagtctgatgtcatgagatctaaaaatgaagaaaatgaagcctacttatctgaaatagagactattggacaagcatatgatgacatgcaaacccaaaaccaacatctgttgcatcagattactgagagagatgactacaatattaagcttgttttagaaggtgtaagggctagacaaaagcaggattcttttatcatggagatgcgattgatggaacaagagatgcagcaatcaaatgtatctctgaatttatacaatacaaaagctgcaaaaattgaagaccagatgagattttgctcagatcagattcaaaaacttgtggacaataaacttcaaagttctgtcgatttggaaaatacacaaagaaggctgtcagatattagaccgtcatcgcaacaggttaggaatacagtggtggaagtgcaatctaaaataaccagtagtcgggtgactcatatggagttactagtagatcttgagaaagaaaggtttgccaaaaaaagagtagagaaagatctagaggttgctaggagaaacttttcacatcttaaagcacaagatgaagattcctctgaaactgataagcttcaacaggaactgggggagtacagggatattgtcaagtgcagtatctgtcgagacaggacaaaagaggtggtaattacaaaatgctatcacttgttctgcaactcatgtatccagaaaattgctgggagccggcagcgcaaatgtccacaatgtggtgcatgctttggggctaatgatgttaagccggtttatttgtaactacattccatcatgctttttgagaagaccccagtgttcttttgaaaacgatctggtgtatggttcaattgtatgctcgtgccaactgttgagatcaggaacgttggcagcagcaatcaatgggtgcctttctcctttcattttggaaatgattctttttgctggtacttccaagtttcaaagtaccacttgtacactttcgtgaatgtgagatgtttggttttttactttcagtgcaaagaatttgaagccacacgaaacatgatattcgttctttgcagatttatcataattcttcttccaatgagatttggagaggccaatgaaggttgttctttgactgtacaattaatatttcaaactataaaaaccccgaactggccattgatcaatatgtgccttggaagttgactcctaagagtgcaatgacaatgtcttacactttagatcaacagttctttttcctgctgctatggcagaagttcaaattttggcttcacaggcttgtgttgtacttgtatatatcttagattcatacgaggtcgttcaattttggtttatcacagcctgtaatctgtgtaatcgtgtagatgatatgccaagatatcattgtaattgatgttgtgttgtaatctacgaatgcccgatttaattgaattatagttattctt

SEQ ID NO: 49 - DNA, 2637 bp, Arabidopsis thaliana
atggcgagcacaggcgagcctgaccgtaaaaggcgtcactttagctccatatcaccttctgaagctgcagccgccgtaaagaaacagcctttcttttggccctcctccgaggacaagcttgatactgcagttcttcagttccaaaatcttaagctatcacaaaagctagaggctcagcaggttgagtgttctattcttgaggataaactctctcagatcaaggaaaaacaattaccatacaactccagtttgaagactgtccataagtcttgggaaaagcttacagcttcagtggaatcatgctctgttcgtgtgagtgattcaagcagcggagctcataggtttgtaaacaaggaggatgggtcttctccagccgtgaaaaacgatttcatcaaccggctacttgaaactggtgctactgagagctcctcatccaatatctgctcgaatcagatggaagaaaatggagtgaatacgtcaagccagatgacgcaaaccttgtataatctagtagccgcgacagaggatttgaggtgtctgaaggatgaattatatcccacagttctcagaaccaatcttggtaaagatttgtgcggtcagctagctctgagtgagttggaatcagaaattaaaagtttcagaggggatctagatgatgtacttgtgaagttcaaatcactttctagagaattgcagagtcatcgcgatgctgatgctaaagttagagtagacctcaaacgaataagaggggagctagaggatgaggttgtggagcttcagcagtgtaatggtgacttgtcagcattgagagcagaaagggatgcaacagctggggcgtttttcccagtgttgagtcttggaaataagcttgctaccagtgatcgggagagggataaacaaagggatctgcaagacatggaaacagttctgaaagagttaacggtcctggcttcaggcaggctacaacagctaaaaaatcttcatgaggagaggacaaagatgcttggaaaaatgagtaatttacagaacaagtcaaagtctgtgaggtgcatctcatcttctcaagcctgcctttctttgaaagaccagctagaaaaatccaaagaagcagttttccagtatatggctttacttgagaaactgcaggttgaaaaagatagtatagtctggaaggaaagggagataaatataaaaaatgaactaggtgatgtttctcgaaagacgtctgctgttactgattctagaatggcttctttggattcggagatacagaaacaactggatgaaaaaatgcgaatcaagactaggctgggaaatatatcaagagagcgaggtagaaaagaaatctttgcagatatgaaggcattaatttcttcgttccccgaggaaatgagttccatgcgtagtcaattaaacaattataaagagactgctggaggtattcattctctgcgggctgatgtccagtccctctctggggttctatgtaggaagacaaaagagtatgaagcattgcaattgagatcagctgattatgcttctcagttaggtgacctgaatgctacggtttgtgatttgaagaacagtcatgaggagttaaagttgtttctggacatgtataaacgtgagtccactgatgcgagggacatagctgaagccaaggaacaggagtacagggcttgggctcatgttcagagtttgaaatcatcccttgatgagcaaaatctggagttgcgcgttaaggcagcaaatgaagctgaagccgtttcccaacaaatgttggctgctgcggaagcagagattgctgatttaaggcagaaaatggatgattgtaaaagggatgtcgccaagcattctgatatcttgaaatctaaacatgaagaacatggaacatatctttctgaaatacagacaattggaagtgcctatgaggacattgtaccgcaaaaccaacggcttttgcttcaagttacagagagggatgactataacatcaagcttttcttggaaggcataacttctaggcagatgcaagatactctgcttatcgataaatacatcatggataaggatatacagcaaggcagtgcatatgccagtttcctatccaagaaatcatcaagaattgaagatcagttgaggttctgcacagatcagtttcagaaactagcggaagataaatatcaaaagtctgtttctcttgaaaatctgcaaaagaaacgtgcagacatcgggaatggcttggaacaagctaggtcaaggctggaggagtcccattctaaagttgagcaaagtcggctggattatggggcattagaactggaactggagattgaaaggttcaataggagaaggatagaggaggaaatggaaatagccaaaaagaaagtttctcgtcttcggtctctcatagaaggatcatcggccattcaaaagctccgacaagaactcagtgaatttaaagaaattctgaagagtaaggccagcaacgatcgcccaaaagaggtggtgattacgaagtgctaccatttgttctgcaacccatgtgtgcaaaagctcacaggaactcgacaaaagaagtgtccaacatgctcagcaagttttggaccaaatgatattaaacctatctacatatga

SEQ ID NO: 50 - DNA, 1827 bp, Arabidopsis thaliana
atggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatga

SEQ ID NO: 51 - protein, 608 aa, Arabidopsis thaliana
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 52 - DNA, 1938 bp, Arabidopsis thaliana
atggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaagcctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaacttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcctgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatga

SEQ ID NO: 53 - protein, 645 aa, Arabidopsis thaliana
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 54 - DNA, 810 bp, Arabidopsis thaliana
atggattgttatgctgaagagcttgttgtgcctaattatcaagaatcatcatcagagacatacccatctactggtatgtggggtggatggagcatgagctcccctgaagcagctgagaaatgtttcgattacgatggtttcaatggagaaggaatgatgtatagtcagatgagtatgaggactagtgaagaagaagaagagtctaaaagatcaaaggctttctatggtgcttcttcacttcacgatttcgaaggcatcgaacagatggatgatatgttcttaagttcaattttggaggatgttccagaggatgatggagatgttcaccgcgcgaccagtagcaataacagtgtcggttcttcttctatgtatggtggtggtagggaagtccctatgttccattgtcatgacatgtctttcaaggaggaagctccatttacaatctcggatctgtctgaagagaacatgttagattcaaactatggggatgaactgtcttctgaagaattcgtgttgcaggatctacaaagggcttcacaaaagttgactgatgagacacgcaaatgtttccgggatactttttaccgacttgcaaggagctcacaagataaatctgattcagtcagccccaactcggaagagctgcttatgcaaacgtctagatatgattatggtgatggaaacaggtttagtagagaggaagagatagaatctgaaacgaattcaatcgatagagctgtcgcaaacctcacattcaacaaaatggaatccaacataagcaattttcctctgtcggaaagagtacagtag

SEQ ID NO: 55 - protein, 269 aa, Arabidopsis thaliana
MDCYAEELVVPNYQESSSETYPSTGMWGGWSMSSPEAAEKCFDYDGFNGEGMMYSQMSMRTSEEEEESKRSKAFYGASSLHDFEGIEQMDDMFLSSILEDVPEDDGDVHRATSSNNSVGSSSMYGGGREVPMFHCHDMSFKEEAPFTISDLSEENMLDSNYGDELSSEEFVLQDLQRASQKLTDETRKCFRDTFYRLARSSQDKSDSVSPNSEELLMQTSRYDYGDGNRFSREEEIESETNSIDRAVANLTFNKMESNISNFPLSERVQ

SEQ ID NO: 56 - DNA, 1254 bp, Arabidopsis thaliana
atgagttttgatcaaagaagacaacttgtcttgaagctgtcgaaagaatccgagagagaatttaaagaagtcttgaaggactggagctgcaacgagattcgagagctcttacgtgcagaatcaaagaaagatataaagtacaccggtttgacgaaagatgagatcatcacaaggcttttcaacattgtatcaaagaaaaacactagagatcatgaggtagaagagataattccatcaccaaaaagacagaaaagagatcttgtgactccattagctaaagctaaaggtaacgaaacatgttctttagtaaagcaactgatcattgcaaatgaagaaagaagagtaggcgtgttttgttaccgcattctcttggctcataagcttctcaagggcacaaagaagtacataatagtatctgaagaggtggagaaagctgtgatgcatctgaaaaatgaatttggtgttcccatttcttgtcttccatcgaagatgagtagagggctcgttaacagactttgctgcgctgagaaagtcaagaaacattgctcttctgctttgaaagagcttgatggtcttccactgccttctactatccaaggatcaatgaagatcagaattgagtctgtacttgcaacttctgtgactttcgatattgaagccgaagaatctttctcatggggagataccaatcattaccgcatggtgtatcgtaaggtctcagagaaacattcctcaaaggatttgactcgtgagttgttcagtacatcaagtcaccaaaggtttacagtcatggaacttactccagctacagagtattggttcaaaatagtttcctttagcggcgtcgaagaattgagcgtagatgaattcatagtctctacaaaaaccctccaagacgaagaagtggcagcagttttattgaatatgtcaaactgcaacaatgccaacaaaatggagaaatcaggaagctgcagttttgggtttgaggaatgtgtgaatctcattaggcagctagagtgctcaggtcaggtcaagagtgatttcagaaagaagtttctgacgtggtattgcttaaaggcaacggataaggagaaacatgttgtagagatctttgtggatactttcaaagacgataaagaagctttggctaagcagctcattgatacattctctgattgcataacaaggaagcatcctgagattggtggtggcagtgagtctgctggagtgtctttgattctgctgcaggattga

SEQ ID NO: 57 - protein, 417 aa, Arabidopsis thaliana
MSFDQRRQLVLKLSKESEREFKEVLKDWSCNEIRELLRAESKKDIKYTGLTKDEIITRLFNIVSKKNTRDHEVEEIIPSPKRQKRDLVTPLAKAKGNETCSLVKQLIIANEERRVGVFCYRILLAHKLLKGTKKYIIVSEEVEKAVMHLKNEFGVPISCLPSKMSRGLVNRLCCAEKVKKHCSSALKELDGLPLPSTIQGSMKIRIESVLATSVTFDIEAEESFSWGDTNHYRMVYRKVSEKHSSKDLTRELFSTSSHQRFTVMELTPATEYWFKIVSFSGVEELSVDEFIVSTKTLQDEEVAAVLLNMSNCNNANKMEKSGSCSFGFEECVNLIRQLECSGQVKSDFRKKFLTWYCLKATDKEKHVVEIFVDTFKDDKEALAKQLIDTFSDCITRKHPEIGGGSESAGVSLILLQD

SEQ ID NO: 58 - DNA, 2328 bp, Arabidopsis thaliana
atgcgcgacacaacatggctcgagcgacttggcctggctctgcgaaccgccatggcttgtctcatcgtgagcttaaccactttgtacggtcccaaaccactaagacacttcacaacgtttccagccttttcttacctgaccacaatcttgatctggctctccgatgctgaaccaacatacggcgaagttctcaagtgctgtcttgatgtctcttacgccacttttcagacaatagccattgcgctagtgagtgtcttggtggttggaccagcttcactagggaatggcttggtggctccagttgctgtggctctagcttcattcatagtggctttccccgtgtccacgagtctgctgactaaacggattgcctttgggcagattgttgtagtctacgtgacttttgtggtgttcaatggagaggtggctcatgtattcatgctcccggttcatgtggcaggcagtacagcacttggagccattgcttcactcatcgcagtgcttctcccgtttccaaggctggctcatagtcagatgagtaagggttgcaaattatatgctgaaaatgctcttgagaggttgaatatgtttgtggagatcatgatggcacgagacaacaccacagctcaggttttgatcgcacgggctgcttcattgtctgcagcagctaaaaacacactcaagaacatcaaaatccaccatgagcgtatatcatgggagagaccagatacaagattcttgagcaggaagcagaagttggatcctgcagagaaactgcatgcaacagattttctgttgaggggattggagctggctttgggctcttgcagttcctttcctcaaggcatgagccgcgacgaactgactcgtcttttagaaggtcccaggacacatattgctccacggtcagaatctactctcaagtcccaagatagtctagggtggcatcatgaggctgagtctctgtctactgcagctttaccggtttgcttcttccggtactgcgtagaactcttcagaggtgatttcttatctttgagacaagacagtaaatccgtaaatggaaggaccacggaggaagaaattcatccagcaaacgaagggttgtccatggccagaaagttttgggacattctctgtgtctggatggccagagaaaggtttgtttttgcattcaagtgctcaatttctcttggccttgcggtgctgtttggtatactgtataataaaaataacgggtattggtcgggtctaactgtagccattagccttgtaagcggtaggcaagcaacactaacagtagcaaattctcgtctacaagggacagccatgggatcagtctacggtctaatatgttgttctgttttccaaagactagaagaattcaggttcttacctcttctcccttggataatcctcgccgtcttcatgaggcacagcaaagtctatggccagcctggaggagttacggctgcaattgctgcactgttgatacttgggaggagaaattatggagctccaactgaatttgcaatcgctcgcatcgttgaagcttcgatcgggttgctctgttttgtcttcggggagattcttgtcacccctgcgagagcagcaacgcttgcaagaaccgaaatttcacactgtctcgatgccctcttagattgcatccaatcactcgttctttgttctgagcagaagaaccagaaagtggttgcagatttgagaaaaagtcaggtaaaactcaaatctcatgttgaagcattagagaggtttgcagcagaagccttaacagagcctaagattccgttcctccgccggctcaacacggacagttacaacaggcttttgggctctttctcgaagatatctgatctttgtctctatgtttgtgatggcctcaaaaatctatctggagttcaaccaacacttgcatttccttgggacaacatcactcatgagcttagagccttccaagaaaagcttcacccttcggtgaaatgcttaaaagagatttctcaaaccaagtctcaagcaagactccaaaaggagttgcagaagagaaagatctgccatgatgttgaagcaggaacaacatcaaacgacaactactcatacatggagctgggtccaagccaggctgatgtggagaggttttcggtttctttcgtcatgctactgaaggaagcaacagacaagataagttgtaacacagcagacgatgcgttcaagagtgaaactgccctatgtctgagcagtctagggttctgcattagcagattaatgcaggaaacaatatgtattatgacagaaataacccatacaacttga

SEQ ID NO: 59 - protein, 775 aa, Arabidopsis thaliana
MRDTTWLERLGLALRTAMACLIVSLTTLYGPKPLRHFTTFPAFSYLTTILIWLSDAEPTYGEVLKCCLDVSYATFQTIAIALVSVLVVGPASLGNGLVAPVAVALASFIVAFPVSTSLLTKRIAFGQIVVVYVTFVVFNGEVAHVFMLPVHVAGSTALGAIASLIAVLLPFPRLAHSQMSKGCKLYAENALERLNMFVEIMMARDNTTAQVLIARAASLSAAAKNTLKNIKIHHERISWERPDTRFLSRKQKLDPAEKLHATDFLLRGLELALGSCSSFPQGMSRDELTRLLEGPRTHIAPRSESTLKSQDSLGWHHEAESLSTAALPVCFFRYCVELFRGDFLSLRQDSKSVNGRTTEEEIHPANEGLSMARKFWDILCVWMARERFVFAFKCSISLGLAVLFGILYNKNNGYWSGLTVAISLVSGRQATLTVANSRLQGTAMGSVYGLICCSVFQRLEEFRFLPLLPWIILAVFMRHSKVYGQPGGVTAAIAALLILGRRNYGAPTEFAIARIVEASIGLLCFVFGEILVTPARAATLARTEISHCLDALLDCIQSLVLCSEQKNQKVVADLRKSQVKLKSHVEALERFAAEALTEPKIPFLRRLNTDSYNRLLGSFSKISDLCLYVCDGLKNLSGVQPTLAFPWDNITHELRAFQEKLHPSVKCLKEISQTKSQARLQKELQKRKICHDVEAGTTSNDNYSYMELGPSQADVERFSVSFVMLLKEATDKISCNTADDAFKSETALCLSSLGFCISRLMQETICIMTEITHTT

SEQ ID NO: 60 - DNA, 1407 bp, Arabidopsis thaliana
atgggggagattgtggttttaagtagtgatgatggtatggagactataaagaacagagtaaagtcatcggaagttgttcagtgggagaagtatttgcctaaaactgtacttagggttttgttagttgaatctgattactcaactcgtcaaatcatcactgcccttcttcgtaaatgctgttacaaagttgtagctgtttctgatggtttagctgcgtgggaggttctaaaggagaagtcacataacattgatcttatactaacagagctggatttgccatctatatctggttttgctctgcttgctttggtaatggagcatgaagcttgcaagaacattcctgtcataatgatgtcttctcaagattcgataaaaatggtgttgaagtgtatgctgagaggtgctgctgattatctaatcaaaccaatgaggaaaaacgagttgaaaaatctatggcaacatgtttggagaagactgactttgcgtgatgatcctactgctcatgctcaaagcttaccagcttcacagcacaaccttgaagatactgatgaaacttgtgaagattccagatatcattcagatcaaggaagtggtgctcaggctatcaattacaatggtcacaataagctgatggagaatggcaaatcagtggatgaaagagacgagtttaaggaaacttttgatgtgacaatggatttgattggtggaattgacaagcgtcctgatagtatttataaagacaagagtcgagatgagtgtgttggtcctgagcttggactttctctgaaaagatcttgctctgtaagttttgagaaccaagatgaaagcaagcatcaaaagcttagcctctctgatgcgtcggccttctcaagatttgaggaaagcaagtcagcagaaaaagccgtcgttgctttagaggagagtacttcaggtgagccaaagacaccaaccgaatcacatgaaaagttaagaaaagtaacatctgatcaaggaagcgccacaacgagcagcaaccaggagaatatcggatcatcaagcgtaagcttccgtaaccaagttcttcagtccacagtaacgaatcagaagcaagattcacccataccggtagaatcaaatcgcgagaaagcagctagcaaggaagtagaagctggttctcaaagcaccaatgaggggattgctggacaaagcagtagcacagagaaaccaaaggaagaagaaagtgcgaaacaacgttggagtagaagccagagagaagctgcattgatgaagttccggttgaagaggaaagatcgatgctttgacaaaaaggttcggtaccagagcaggaagaagctagcagaacaacgtcctcgagtgaaaggccagttcgtgcgaaccgtgaattcagacgcgtctacaaaatcatga

SEQ ID NO: 61 - protein, 468 aa, Arabidopsis thaliana
MGEIVVLSSDDGMETIKNRVKSSEVVQWEKYLPKTVLRVLLVESDYSTRQIITALLRKCCYKVVAVSDGLAAWEVLKEKSHNIDLILTELDLPSISGFALLALVMEHEACKNIPVIMMSSQDSIKMVLKCMLRGAADYLIKPMRKNELKNLWQHVWRRLTLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 62 - DNA, 897 bp, Arabidopsis thaliana
atgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaagctgatattggatcaaagggcttattaaatgttagtagcccttctacatctggcatgggaagctcaagccgaacagtatcaggttctgagattgtaagaaaggctaaacagcctccagtgcttcacggtgttcctgattttgctgaagtttataatttcattgggagtgtctttgatcctgaaacgagaggccatgtggaaaagctcaaggaaatggatcctataaatttcgaaactgttctgttattgatgagaaacctcacagttaacttatcaaaccctgatttagaatccactaggaaagtcctcttatcatatgacaacgtgacgaccgagctcccaagcgttgtttcccttgtcaagaactcaacaagcgacaaatcagcataa

SEQ ID NO: 63 - protein, 298 aa, Arabidopsis thaliana
MSSSPSRNPTNAEAPPPPPTSTDAVAEGSSKKVRKPYTITKSRESWTEEEHDKFLEALQLFDRDWKKIEDFVGSKTVIQIRSHAQKYFLKVQKNGTLAHVPPPRPKRKAAHPYPQKASKNAQMPLQVSTSFTTTRNGDMPGYASWDDASMLLNRVISPQHELATLRGAEADIGSKGLLNVSSPSTSGMGSSSRTVSGSEIVRKAKQPPVLHGVPDFAEVYNFIGSVFDPETRGHVEKLKEMDPINFETVLLLMRNLTVNLSNPDLESTRKVLLSYDNVTTELPSVVSLVKNSTSDKSA

SEQ ID NO: 64 - DNA, 1035 bp, Arabidopsis thaliana
atggctccggggcttactcaaaccgctgatgctatgtccaccgtgacgataacaaaaccgtcactgccatcagtccaagacagcgatcgagcttacgtgacgtttcttgctggaaacggtgattacgtgaaaggagtcgttggtttagccaaagggttaaggaaagtcaaatcggcttatccactcgtagtagcgatgttacccgacgtcccggaggaacaccgtcgtatacttgtggatcaaggatgcatcgtccgtgaaatcgaacccgtttacccacccgagaaccaaactcagttcgccatggcttattacgtcatcaactactctaaactccgtatctggaagtttgtggagtatagtaaaatgatatatttagatggagacattcaagtttacgaaaacatcgatcacttgtttgacctaccagatggctatttgtacgcggtgatggattgtttctgtgagaaaacatggagtcacacgccgcaatacaagatcagatattgccaacaatgccccgacaaagtccagtggccaaaagcggagcttggagagccaccggctctttacttcaacgccggaatgttcttgtacgagcctaacctcgagacttacgaggatctactacgaacacttaaaatcactcctccgactcctttcgctgaacaggattttttgaacatgtactttaagaaaatctacaagccgattcctttagtgtacaatctcgtccttgcgatgttatggcgtcacccagaaaatgtagagcttggaaaagtcaaggtggttcactactgtgcagcgggttcgaagccgtggagatacacagggaaagaagcgaacatggagagggaagatataaaaatgttagtgaaaaaatggtgggacatttacgacgacgaatccttggattacaagaaacctgttaccgttgtggacacagaggtcgatctcgtgaatctgaagccgttcatcaccgctcttactgaagctggccggctcaactacgtgaccgcaccgtccgctgcttga

SEQ ID NO: 65 - protein, 344 aa, Arabidopsis thaliana
MAPGLTQTADAMSTVTITKPSLPSVQDSDRAYVTFLAGNGDYVKGVVGLAKGLRKVKSAYPLVVAMLPDVPEEHRRILVDQGCIVREIEPVYPPENQTQFAMAYYVINYSKLRIWKFVEYSKMIYLDGDIQVYENIDHLFDLPDGYLYAVMDCFCEKTWSHTPQYKIRYCQQCPDKVQWPKAELGEPPALYFNAGMFLYEPNLETYEDLLRTLKITPPTPFAEQDFLNMYFKKIYKPIPLVYNLVLAMLWRHPENVELGKVKVVHYCAAGSKPWRYTGKEANMEREDIKMLVKKWWDIYDDESLDYKKPVTVVDTEVDLVNLKPFITALTEAGRLNYVTAPSAA

SEQ ID NO: 66 - DNA, 1320 bp, Arabidopsis thaliana
atggataaaaacggcatagttttgatgcgaaaatatgaattaggtcgtcttctaggtcaaggcacattcgcaaaagtgtaccacgcacgcaacataaaaacaggagaaagcgtagcgatcaaggtgatcgacaaacagaaagttgcgaaagtcggattaatcgatcaaatcaaacgagaaatatcagtgatgcgtctcgttcgtcacccccacgtcgtcttcctccatgaagtaatggcgagcaagacaaagatctatttcgctatggaatacgttaaaggcggtgagctttttgataaagtctctaaaggaaagcttaaagaaaacattgctcgaaaatatttccagcaattgatcggagcaatcgattattgccatagccgcggagtttaccaccgcgatctcaaaccggagaatcttcttctagacgaaaacggcgatttgaaaatatcggattttggccttagcgcgttgagggagtcgaagcagcaagatggcttgcttcacacgacatgtggaacacctgcttacgtggcacctgaagtgataggcaagaaaggttatgatggagctaaagccgatgtttggtcttgcggggttgtgttgtacgtgctattggctggatttcttccgtttcacgagcaaaatcttgtggaaatgtatcggaaaatcacgaaaggcgaattcaaatgtccgaattggtttcctcccgaggtcaagaagttgttgtctcggattcttgaccctaaccctaattcaagaatcaagattgaaaaaatcatggagaattcctggtttcaaaagggtttcaagaagatcgaaacgcctaaatctcccgaaagtcatcagatcgactcactgatcagcgatgtccacgcagctttttccgtaaaaccgatgtcttacaacgcgtttgacttgatctcttcgctgtctcaaggattcgatctctcgggtttgtttgagaaagaagagagatcagaatcgaagtttacaacgaagaaagatgcaaaagagatagtgtcgaaattcgaggagatagcaacaagtagtgagagattcaatttgacgaagagcgatgtaggagtgaagatggaagataagagagaaggaagaaaaggacatcttgcgattgatgttgagatatttgaagtgacaaatagttttcatatggttgagtttaagaaaagtggaggtgatacaatggagtataagcaattttgtgatcgtgagcttaggccttctttgaaagatattgtttggaaatggcaaggaaacaacaacaatagcaacaatgagaagattgaagtgatacattaa

SEQ ID NO: 67 - protein, 439 aa, Arabidopsis thaliana
MDKNGIVLMRKYELGRLLGQGTFAKVYHARNIKTGESVAIKVIDKQKVAKVGLIDQIKREISVMRLVRHPHVVFLHEVMASKTKIYFAMEYVKGGELFDKVSKGKLKENIARKYFQQLIGAIDYCHSRGVYHRDLKPENLLLDENGDLKISDFGLSALRESKQQDGLLHTTCGTPAYVAPEVIGKKGYDGAKADVWSCGVVLYVLLAGFLPFHEQNLVEMYRKITKGEFKCPNWFPPEVKKLLSRILDPNPNSRIKIEKIMENSWFQKGFKKIETPKSPESHQIDSLISDVHAAFSVKPMSYNAFDLISSLSQGFDLSGLFEKEERSESKFTTKKDAKEIVSKFEEIATSSERFNLTKSDVGVKMEDKREGRKGHLAIDVEIFEVTNSFHMVEFKKSGGDTMEYKQFCDRELRPSLKDIVWKWQGNNNNSNNEKIEVIH

SEQ ID NO: 68 - DNA, 912 bp, Arabidopsis thaliana
atggcagcaggactatcaacaatcgccgtaacactcaaaccactcaaccgctcttctttctccgcaaaccaccctatatccaccgcagttttccctccatctctaagattcaacggcttccgacgtcgaaagattctcaccgtttgtttcgtcgtggaagaacggaaacaaagctctcccatggacgatgacaacaaaccagaaagcacgacaagctcttctgagatcttgatgacgtcgcggcttctcaagaaagcggagaagaagaaatcagagaggttcacttatttaatagcagctgtgatgtcgagctttggtatcacttctatggctataatggctgtttattaccgattttcttggcaaatgaagggaggtgaagtgtctgtgttagagatgtttggtacatttgctctttccgttggtgctgccgttgggatggagttttgggcaagatgggctcatagagctctttggcatgattctttatggaacatgcatgagtcacatcacaaaccaagagaaggagcgtttgagttaaacgatgtgtttgctataacaaacgcggttcctgcgattggtctactctattatggattcttgaataaaggacttgttcctggtctctgcttcggtgccggactgggaataacgatgtttggaatggcttacatgttcgttcacgatggacttgtgcacaagagattccctgtaggtcccattgccaacgttccttaccttcgaaaggtcgccgccgctcaccagctacaccacacagacaaattcaaaggtgtaccatatgggctgtttcttggaccaaaggaagtagaagaagtgggaggaaaagaagagttggagaaagagataagccggagaatcaaattatacaacaagggttcttctacctcttaa

SEQ ID NO: 69 - protein, 303 aa, Arabidopsis thaliana
MAAGLSTIAVTLKPLNRSSFSANHPISTAVFPPSLRFNGFRRRKILTVCFVVEERKQSSPMDDDNKPESTTSSSEILMTSRLLKKAEKKKSERFTYLIAAVMSSFGITSMAIMAVYYRFSWQMKGGEVSVLEMFGTFALSVGAAVGMEFWARWAHRALWHDSLWNMHESHHKPREGAFELNDVFAITNAVPAIGLLYYGFLNKGLVPGLCFGAGLGITMFGMAYMFVHDGLVHKRFPVGPIANVPYLRKVAAAHQLHHTDKFKGVPYGLFLGPKEVEEVGGKEELEKEISRRIKLYNKGSSTS

SEQ ID NO: 70 - DNA, 1464 bp, Arabidopsis thaliana
atgaatgggaatattgtaggaaaggttccgattggggaatgtaaagcgactgtagtttacatgtccggttacttaccaggagctgcgtcggagaaatccccgattctctcccctgttcccgtgcgtttatcggcggctgttcacggtggagattcgtggaaagatgtatgtggtggtggttgtggattcgctatggctatttcagagaaaggaaagcttataacttggggttctactgatgatgaaggacagagctatgtggcttctgggaagcatggggaaactccagagccgtttcctcttcctacggaggctccagtcgttcaggcttcttcaggatgggcacattgtgcggttgtaacagagactggtgaagcatttacttggggttggaaggagtgcattccatcaaaggatcctgttggaaagcagcagagtggctcaagtgagcaaggtgatatcgcatcacaaggttcaaatgcggctagtggtacgacactacagaatgagaaccaaaaggtaggggaggaatcagtgaagcggagacgggtttcaactgccaaagatgaaactgaaggccatacatctggaggcgacttctttgctacaacaccttcacttgtgagtgttggccttggagtgaggatcaccagtgttgctactggtggtcggcatacgctggcattgtcagttgaagattcatttgaggatgatcatgtttttacggaagtttcagatttaggacagatttggggttggggatatggaggcgaaggtcaactaggattgggttcccggattaaaatggtgtcatctcctcatctaataccttgccttgaatcaattggatctggaaaagaaagatctttcatattacatcaaggaggaacaacaaccacgtctgctcaagcttctagagaacctggtcagtacatcaaggccatttcatgtggaggtcgtcatagcgcagcaattacagatgctggcgggttaataacttttggctggggactctatggacagtgtggccacggaaacacaaatgaccagttaaggcccatggctgtgtcagaagtgaagagtgttcggatggaaagcgtagcagctggattgtggcacactatttgcatctctagtgatggtaaagtgtatgccttcggtggaaaccaatttgggcaactgggaactggtactgatcatgctgagatattaccgaggttgctggatggccagaatttggagggcaaacatgcaaaagcagttagttgcggcgcgcgacatagtgcggttttggcagaagatggtcagttgctatgctggggatggaacaaatatggacagctgggtctaggggacacgaatgaccggaacattcctacacaagtccagctggatggctgcagactgagaaaagtggcgtgtggatggtggcatacattgctactaggagattcacccacttga

SEQ ID NO: 71 - protein, 487 aa, Arabidopsis thaliana
MNGNIVGKVPIGECKATVVYMSGYLPGAASEKSPILSPVPVRLSAAVHGGDSWKDVCGGGCGFAMAISEKGKLITWGSTDDEGQSYVASGKHGETPEPFPLPTEAPVVQASSGWAHCAVVTETGEAFTWGWKECIPSKDPVGKQQSGSSEQGDIASQGSNAASGTTLQNENQKVGEESVKRRRVSTAKDETEGHTSGGDFFATTPSLVSVGLGVRITSVATGGRHTLALSVEDSFEDDHVFTEVSDLGQIWGWGYGGEGQLGLGSRIKMVSSPHLIPCLESIGSGKERSFILHQGGTTTTSAQASREPGQYIKAISCGGRHSAAITDAGGLITFGWGLYGQCGHGNTNDQLRPMAVSEVKSVRMESVAAGLWHTICISSDGKVYAFGGNQFGQLGTGTDHAEILPRLLDGQNLEGKHAKAVSCGARHSAVLAEDGQLLCWGWNKYGQLGLGDTNDRNIPTQVQLDGCRLRKVACGWWHTLLLGDSPT

SEQ ID NO: 72 - DNA, 1167 bp, Arabidopsis thaliana
atggacagaatcagtgggttgcctgatgaattgttggtcaagattatatcgtttgttccgacaaaagtagctgtatccactagcattttgtccaaacgatgggagtctctttggaagtgggtgcctaaacttgagtgcgattgtactgagcctgcacttcgggattttattctcaagaatctgccgttacaagctcggatcatagaaagcttgtacctcagatttcgtcgtgagtcatttctgtttcaggatatcaaactctggggtggaattgcaatttctcactgcttgcgtgagctacgtatcgactttttttctcactatgccaatccatatgttatattgcccagaagcttgtatacctgcaaatctctggtgaccttgaaactcctaggcttgggtattcgtgtggatgttcctcgagatgtttgtctcccttctttaaaaactttgctacttcaatgtgtggcatactcagaagaagatcctcttcgactgcttctttcctgttgccctgttcttgaagatctggttattgaactagatgatgcaaaccaaaatgtgaaagcgctagttgttattgtcccaactttgcagtgtctatccttgaagatacctgcttcatgttctgatgaacggtatttgattgttaccccttctttgaagtatttcaaagttgaggatgacagagaaattttcaatgctttgattgagaatatgccagagctggaagaagcggatatctatgttacgcaacatattgagacgcttctcgaatcagttacatctgtcaaacgacttacactacgccaattgtacaacagcatagatgagtataagtgtcgtgctggtattgtcttcaaacagcttgaacaactggagctatccatatgcagtgataattggacaaagttagttatatggttgctccaaaattctcccaatctgcgagttctcaatcttgacgctgatagtgattatgaacgttatgaggagtatgaacaggataactggaagaatatacaaagatctgttcctaaatgtttgaagagcagtctcaaaactttggagtttgcagggtacacggcaaggccagaagagagggatttcttgagttttatcttcaaaaaagctcgttgcttgaagacttcatcaatctcgcattga

SEQ ID NO: 73 - protein, 388 aa, Arabidopsis thaliana
MDRISGLPDELLVKIISFVPTKVAVSTSILSKRWESLWKWVPKLECDCTEPALRDFILKNLPLQARIIESLYLRFRRESFLFQDIKLWGGIAISHCLRELRIDFFSHYANPYVILPRSLYTCKSLVTLKLLGLGIRVDVPRDVCLPSLKTLLLQCVAYSEEDPLRLLLSCCPVLEDLVIELDDANQNVKALVVIVPTLQCLSLKIPASCSDERYLIVTPSLKYFKVEDDREIFNALIENMPELEEADIYVTQHIETLLESVTSVKRLTLRQLYNSIDEYKCRAGIVFKQLEQLELSICSDNWTKLVIWLLQNSPNLRVLNLDADSDYERYEEYEQDNWKNIQRSVPKCLKSSLKTLEFAGYTARPEERDFLSFIFKKARCLKTSSISH

SEQ ID NO: 74 - DNA, 330 bp, Arabidopsis thaliana
atgtcgcaacaacaattcaacgccggacagaacagaggccaagctcaagagaaagctgagcaatggaccgagtctgcgaagcaaaccgcacagtccgcatgtgacaaaactgctgatttgacacaatcagcacgtgacaaggctgcagatttgacacaatcagctcgtgacaaaaccgctgatggatctcattccgctaacaaatctgcacaacataaccaggaacaagccgctggtttattcggccagaccggtgaatcagtgaagaacatggctcagggtgctcttgacggtgtgaagaacagtcttggcatgaacgagaagaaatga

SEQ ID NO: 75 - protein, 109 aa, Arabidopsis thaliana
MSQQQFNAGQNRGQAQEKAEQWTESAKQTAQSACDKTADLTQSARDKAADLTQSARDKTADGSHSANKSAQHNQEQAAGLFGQTGESVKNMAQGALDGVKNSLGMNEKK

SEQ ID NO: 76 - DNA, 798 bp, Arabidopsis thaliana
atggcaacatcagctatccagcaatcctccttcgccggccaaacggctctcaagccctccaacgaactcctccgcaaggttggtgtatccggtggtggccgtgtgaccatgcgtcgtaccgtcaagtctactcctcaaagcatctggtacggaccagaccgtcccaagtacttaggaccattctcggagaatacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggttctcagattttctcagaaggaggtcttgattacctcggaaaccctaacttgatccacgcgcaaagcatcttagccatctgggctgttcaagttgtgctcatggggttcattgaaggctacagaatcggaggtggacctctcggagaagggcttgacccgctttaccccggaggtgcgttcgacccattgaacttggctgaggatccagaggctttctctgagctgaaggtgaaggagcttaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaattaa

SEQ ID NO: 77 - protein, 265 aa, Arabidopsis thaliana [sequence omitted]

SEQ ID NO: 78 - DNA, 1119 bp, Arabidopsis thaliana
atggccttcaagtatcttctaccattgcttttactgtcattgttggttgctaattgtgcctcaaggcctttgtatcgtctcccaagcgaagcaaaacatgcaaccaagaaaccacttcagacttcccgtccttacaaccttgcacacagaggatcaaacggagagctccctgaagaaactgctcctgcatatatgagggccatagaggagggtgcagattttatagaaaccgatattttgtcttccaaagacggtgttcttatatgtcaccacgatgttaatctcgatgatacaaccgatgttgcagaccataaggagtttgcagaccgtaagaggacttatgaagtccaaggaatgaacatgaccggcttcttcactgttgattttactctcaaagagctgaaaacacttggtgcaaagcagaggtatcctttcagggatcaacaatacaatggtaaattcccgattattaccttcgacgagtatatttcgatagcactggatgcacctagagtggttgggatatatccagagatcaagaatccggttttcatgaatcagcaagtgaagtgggcggatggtaaaaaatttgaagataaatttgtggaaactttgaagaaatatggatacaaaggctcatatctgtctgaagattggttaaaacagccaatatttattcagtcttttgcagcaacttcgctagtttacatttcaaacatgacagactcaccaaaattgtttttgatcgacgatgtcactattcttaccgaagacactaataagacttacgcagagatcacatcagacgcatatttggattacattaaaccatatgtaattgggattggtccatggaaagacacaattgttcctgtgaacaataaccgtctcatgacaccaacagatttagttgcgagagcacattcgcgtaatcttcaggtccatccatacacataccgtaatgagaaccagtttctgcatttagagtttaatcaggacccttacctagagtatgattattggctcaataagatcggtgttgatggtttgttcactgatttcactggaagtctacacaattaccaggaattgaagtctcctttgcctcagcaacagtga

SEQ ID NO: 79 - protein, 372 aa, Arabidopsis thaliana
MAFKYLLPLLLLSLLVANCASRPLYRLPSEAKHATKKPLQTSRPYNLAHRGSNGELPEETAPAYMRAIEEGADFIETDILSSKDGVLICHHDVNLDDTTDVADHKEFADRKRTYEVQGMNMTGFFTVDFTLKELKTLGAKQRYPFRDQQYNGKFPIITFDEYISIALDAPRVVGIYPEIKNPVFMNQQVKWADGKKFEDKFVETLKKYGYKGSYLSEDWLKQPIFIQSFAATSLVYISNMTDSPKLFLIDDVTILTEDTNKTYAEITSDAYLDYIKPYVIGIGPWKDTIVPVNNNRLMTPTDLVARAHSRNLQVHPYTYRNENQFLHLEFNQDPYLEYDYWLNKIGVDGLFTDFTGSLHNYQELKSPLPQQQ

SEQ ID NO: 80 - DNA, 1101 bp, Arabidopsis thaliana
atgtcgccgtcaatgatagctccggtgatggaagaagagaacaagaaataccaaaaaggcgtgaaacatctttgtgaaaatggtctgaccaaagtaccaaccaagtatatatggcctgaacctgaccgacccatcttgacaaaatcggacaagctcatcaaaccaaacaaaaacctaaagctccccctcatagatttcgctgagctccttggacctaaccggcctcatgttctacgaaccatagccgaggcctgcaaaacctacggcttctttcaggttgtgaatcatgggatggaaggagacgtgagcaagaatatgatagacgtgtgtaagagattctttgagcttccgtacgaggagagatccaagtacatgtcgtcggacatgtcggctccagtacgatacggcacgagtttcaaccagatcaaagacaatgtcttttgttggagagacttcttgaaactctatgcacatccactccctgactatcttcctcattggccttcttctccttctgacttcaggagttcggcggctacatacgctaaagagacgaaagagatgttcgaaatgatggtcaaagccatcttagaaagtcttgaaattgatggcagtgatgaggcggctaaggagttggaagagggaagtcaggtggtggtggtgaactgttatccaccgtgtccggagccagagctgacgctagggatgccaccgcactcagactacggcttcttgacgcttctacttcaagacgaagtcgaaggtcttcaaattctgtatcgtgacgagtgggtcaccgttgatcccatccctggctcttttgttgtcaacgtaggcgatcatctcgagatatttagcaatgggaggtataaaagcgtgctacatagggtattggtgaactctacaaaacctaggatatcggtggcgtcgctacacagcttccctttgacttctgtcgtaaagccatcgccgaaactcgtcgataaacataatccatcacagtatatggacactgattttaccacttttcttcagtatataacttctcgtgaacccaaatggaagaattttcttgaatcacgcaagattcaccatgtatga

SEQ ID NO: 81 - protein, 366 aa, Arabidopsis thaliana
MSPSMIAPVMEEENKKYQKGVKHLCENGLTKVPTKYIWPEPDRPILTKSDKLIKPNKNLKLPLIDFAELLGPNRPHVLRTIAEACKTYGFFQVVNHGMEGDVSKNMIDVCKRFFELPYEERSKYMSSDMSAPVRYGTSFNQIKDNVFCWRDFLKLYAHPLPDYLPHWPSSPSDFRSSAATYAKETKEMFEMMVKAILESLEIDGSDEAAKELEEGSQVVVVNCYPPCPEPELTLGMPPHSDYGFLTLLLQDEVEGLQILYRDEWVTVDPIPGSFVVNVGDHLEIFSNGRYKSVLHRVLVNSTKPRISVASLHSFPLTSVVKPSPKLVDKHNPSQYMDTDFTTFLQYITSREPKWKNFLESRKIHHV

SEQ ID NO: 82 - DNA, 888 bp, Arabidopsis thaliana
atggctgtatcatttcaaaccaagaaccctctaagacccatcaccaacatcccaagaagctatggtccaacgcgtgtacgtgtcacatgctctgttactaccaccaatcctcagcttaatcatgagaaccttgtagttgagaaacgccttgtgaatcctcctctttccaagaacaacgacccgactctgcaatcgacatggactcatcggttatgggttgcagcgggaagtacaaccatatttgcctctttcgctaaatctatcattggagggtttggttctcatctttggctccaaccagctttagcgtgttatgcagggtacgtgtttgctgatctaggctccggtgtttaccactgggccattgataactatggtggtgcatcaacacctatagttggagcccaacttgaagcgtctcagggtcatcacaagtatccctggacaatcacaaaacgtcaattcgccaacaattcatacactatcgctcgagccataacttttatagttctaccactaaaccttgcaattaacaatcctctgtttcatagctttgtgagcacatttgcattttgcattttgttaagccaacaattccatgcttgggctcatggaaccaagagcaagcttccacctctcgtgatggcgttgcaggacatgggactgcttgtctcacggaaagatcacccgggacatcaccaagcaccgtataacagcaactactgtgtagtgagtggggcatggaacaaagttttggacgaaagtaacttatttaaggcattggagatggcgttgtttttccagttcggtgtgagaccaaactcgtggaacgagccaaactctgactggacagaagaaaccgagactaatttctttacaaagatttaa

SEQ ID NO: 83 - protein, 295 aa, Arabidopsis thaliana
MAVSFQTKNPLRPITNIPRSYGPTRVRVTCSVTTTNPQLNHENLVVEKRLVNPPLSKNNDPTLQSTWTHRLWVAAGSTTIFASFAKSIIGGFGSHLWLQPALACYAGYVFADLGSGVYHWAIDNYGGASTPIVGAQLEASQGHHKYPWTITKRQFANNSYTIARAITFIVLPLNLAINNPLFHSFVSTFAFCILLSQQFHAWAHGTKSKLPPLVMALQDMGLLVSRKDHPGHHQAPYNSNYCVVSGAWNKVLDESNLFKALEMALFFQFGVRPNSWNEPNSDWTEETETNFFTKI

SEQ ID NO: 84 - DNA, 651 bp, Arabidopsis thaliana
atgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaa

SEQ ID NO: 85 - protein, 216 aa, Arabidopsis thaliana
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 86 - DNA, 2685 bp, Arabidopsis thaliana
atggcgttttcttcttgttttctcttagttcttctgcaaatcttctcagctttacttctttgtcttgctcaagatcagtcaggattcatcagtttggattgcggttcgcctagagaaactagctttcgtgagaaaacaacaaacattacttacatttccgatgcgaatttcatcaataccggtgttggtggaagcatcaaacaaggataccggactcagtttcagcaacaaacatggaacctacggagttttccacaaggcataagaaactgctataccttaaacctaaccataggcgacgaatatctaatcagagccaatttccttcacggcggttatgacgacaaaccctcaacgcaattcgagctctacctcggacctaatctttggtctacagttacaaccacgaacgagaccgaagcatcaatctttgagatgattcatatcttgaccactgatcgtttacaaatctgtctggtcaagacaggaaacgcaacgccttttatctccgctttagagcttcgtaaactcatgaacacaacttacttgactcgacaaggttccttgcagaccttcatcagagcagacgttggcgcgactgttaaccaaggctacaggtacggaatcgatgtgtttgatcgtgtctggactccgtataatttcggaaactggtcacagattagtaccaatcagtcagtgaatataaacaatgactatcaaccaccagagattgctatggtcacagcctctgttccaacagacccggacgcagctatgaacatttcgctagtcggggtggaacgtactgtgcagttctacgtttttatgcattttgcagagattcaagagctcaaatccaatgatacaagagagttcaacatcatgtacaataacaagcatatctatggaccttttagaccacttaatttcaccacgtcttccgtatttacacctaccgaagttgtcgccgatgcaaatgggcagtacatattttcgcttcaaagaacaggaaattcgactttacctcctctgctcaacgctatggagatttattcggttaacttgttgccgcaacaggaaactgatagaaaagaagttgatgcaatgatgaacatcaagtcggcttacggcgtgaacaagattgactgggaaggagatccttgcgtgccgctggattacaagtggtctggtgttaattgcacttatgttgacaatgagaccccaaagatcatttctttggatctgtctacaagtggcttgaccggagagatcttagaatttatatcagaccttaccagtttagaagttcttgacttgtctaacaattctttaactggttcagtcccagagtttctagctaatatggaaaccttaaaactcataaatctatctggaaatgagctaaatggctctatccctgcaactctccttgataaagaacgacgaggatctattacgttaagtatcgaaggaaataccgggctttgttcatctacatcatgcgctaccacgaaaaagaagaagaaaaacactgttattgcacctgttgcagcatcacttgtttcagtattcctcattggagctggaatcgttactttccttatcctcaagaggaagaagagaaccaagcttggtttgaatcctaattcaggaactggtacaacaccgttacattcgaggtctcaccacggttttgaacctcccgttatagcgaaaaaccggaaattgacttacattgatgttgttaagatcacaaacaactttgagagggttcttggtaggggtggttttggtgtggtttattacggcgtcttgaataatgaaccagttgcggtaaagatgctcactgagtccactgcacttggttacaaacagtttaaagccgaggttgagttgcttcttagagttcatcacaaagatctcacatgtcttgttggatattgtgaagaaggagataaaatgtctctaatctatgagttcatggcgaatggtgacttgaaagagcacttatcagggaagcgtggaccgtcgatactaacttgggaaggaaggcttcgtatagcagcggaatcagcgcaaggattggaatatttgcacaatggatgcaaaccgcaaatagttcaccgcgacattaagactactaacatcttattaaacgagaaatttcaagctaagcttgcggatttcgggctttcacggtcttttccacttggaactgaaactcacgtctcaaccatagttgctggaactcccggatatcttgatcctgaatactacagaactaattggttgaccgagaaaagtgatgtgttcagctttggtgttgttctactagagctagtaacaaaccaacccgtgatagacatgaaaagagaaaaatcacacatagctgaatgggtaggtttgatgctatcaagaggagacattaacagcattgtagatcctaagcttcaaggagactttgatccaaacacgatatggaaagttgttgagaccgcaatgacttgcctgaatccgtcttcttcacggagaccgacaatgactcaagtcgtaatggatctgaaagaatgtctgaacatggagatggcaagaaacatgggaagccgtatgacggattcaactaatgattcttcaattgagctgtccatgaatttcacaacagagcttaatccaggagctagatga

SEQ ID NO: 87 - protein, 894 aa, Arabidopsis thaliana
MAFSSCFLLVLLQIFSALLLCLAQDQSGFISLDCGSPRETSFREKTTNITYISDANFINTGVGGSIKQGYRTQFQQQTWNLRSFPQGIRNCYTLNLTIGDEYLIRANFLHGGYDDKPSTQFELYLGPNLWSTVTTTNETEASIFEMIHILTTDRLQICLVKTGNATPFISALELRKLMNTTYLTRQGSLQTFIRADVGATVNQGYRYGIDVFDRVWTPYNFGNWSQISTNQSVNINNDYQPPEIAMVTASVPTDPDAAMNISLVGVERTVQFYVFMHFAEIQELKSNDTREFNIMYNNKHIYGPFRPLNFTTSSVFTPTEVVADANGQYIFSLQRTGNSTLPPLLNAMEIYSVNLLPQQETDRKEVDAMMNIKSAYGVNKIDWEGDPCVPLDYKWSGVNCTYVDNETPKIISLDLSTSGLTGEILEFISDLTSLEVLDLSNNSLTGSVPEFLANMETLKLINLSGNELNGSIPATLLDKERRGSITLSIEGNTGLCSSTSCATTKKKKKNTVIAPVAASLVSVFLIGAGIVTFLILKRKKRTKLGLNPNSGTGTTPLHSRSHHGFEPPVIAKNRKLTYIDVVKITNNFERVLGRGGFGVVYYGVLNNEPVAVKMLTESTALGYKQFKAEVELLLRVHHKDLTCLVGYCEEGDKMSLIYEFMANGDLKEHLSGKRGPSILTWEGRLRIAAESAQGLEYLHNGCKPQIVHRDIKTTNILLNEKFQAKLADFGLSRSFPLGTETHVSTIVAGTPGYLDPEYYRTNWLTEKSDVFSFGVVLLELVTNQPVIDMKREKSHIAEWVGLMLSRGDINSIVDPKLQGDFDPNTIWKVVETAMTCLNPSSSRRPTMTQVVMDLKECLNMEMARNMGSRMTDSTNDSSIELSMNFTTELNPGAR

SEQ ID NO: 88 - DNA, 678 bp, Arabidopsis thaliana
atggtgagcttttgcgagctttgtggtgccgaagctgatctccattgtgccgcggactctgccttcctctgccgttcttgtgacgctaagttccatgcctcaaattttctcttcgctcgtcatttccggcgtgtcatctgcccaaattgcaaatctcttactcaaaatttcgtttctggtcctcttcttccttggcctccacgaacaacatgttgttcagaatcgtcgtcttcttcttgctgctcgtctcttgactgtgtctcaagctccgagctatcgtcaacgacgcgtgacgtaaacagagcgcgagggagggaaaacagagtgaatgccaaggccgttgcggttacggtggcggatggcatttttgtaaattggtgtggtaagttaggactaaacagggatttaacaaacgctgtcgtttcatatgcgtctttggctttggctgtggagacgaggccaagagcgacgaagagagtgttcttagcggcggcgttttggttcggcgttaagaacacgacgacgtggcagaatttaaagaaagtagaagatgtgactggagtttcagctgggatgattcgagcggttgaaagcaaattggcgcgtgcaatgacgcagcagcttagacggtggcgcgtggattcggaggaaggatgggctgaaaacgacaacgtttga

SEQ ID NO: 89 - protein, 225 aa, Arabidopsis thaliana
MVSFCELCGAEADLHCAADSAFLCRSCDAKFHASNFLFARHFRRVICPNCKSLTQNFVSGPLLPWPPRTTCCSESSSSSCCSSLDCVSSSELSSTTRDVNRARGRENRVNAKAVAVTVADGIFVNWCGKLGLNRDLTNAVVSYASLALAVETRPRATKRVFLAAAFWFGVKNTTTWQNLKKVEDVTGVSAGMIRAVESKLARAMTQQLRRWRVDSEEGWAENDNV

SEQ ID NO: 90 - DNA, 699 bp, Arabidopsis thaliana
atgagcaaaatgagaaacctagtagaagaaaagttcctagagttctatgagagttgggttattcaacttgagctatatcttcatcaacttttaattgctcataacaataacactatgagtgagaccgagcttcgacatttgatctcgaagctaactacacatcacaaagcttattatacagccaaatgggcagccataagagaagatgtcttagcttttttcggatcagtttggttaaacccgttagagaatgcttgctcttggttaaccggatggaaaccgtcgatggtgtttcggatggttgataggctgaggaagtcgagagtggtgcttgtggaggctcaggtgaagaaattggaggagctgagagttaagaccaagttcgatgagcaaaaaattgagagagagatggagcggtatcaggtggctatggctgatcggaaaatggtagagctggcgaggcttggatgtcacgtcggaggagaatcggtgatggtggtggaggcagcggtgagaggattatcgatgggtcttgagaaaatggtgaaggctgcggattgtgtgcggctgaaaacgcttaaaggtatattagacattttaactccaccgcaatgcgttgagtttttggcagcggcggctacgtttcaggttcagttacgtcggtggggaaaccgaagacattatgtcactcactcctga

SEQ ID NO: 91 - protein, 232 aa, Arabidopsis thaliana
MSKMRNLVEEKFLEFYESWVIQLELYLHQLLIAHNNNTMSETELRHLISKLTTHHKAYYTAKWAAIREDVLAFFGSVWLNPLENACSWLTGWKPSMVFRMVDRLRKSRVVLVEAQVKKLEELRVKTKFDEQKIEREMERYQVAMADRKMVELARLGCHVGGESVMVVEAAVRGLSMGLEKMVKAADCVRLKTLKGILDILTPPQCVEFLAAAATFQVQLRRWGNRRHYVTHS

SEQ ID NO: 92 - DNA, 876 bp, Arabidopsis thaliana
atgggatcttcatcaaagaacatcgaacaagctcaagattcttatctcgagtggatgagtttgcaatctcaacgcatccctgagctcaaacaactcttagctcaacgacgatctcacggtgatgaagataatgataacaagcttcgtaagttaacgggaaaaatcatcggtgatttcaaaaattacgccgcaaaaagagctgatcttgctcaccgatgtagctcgaactattatgcacccacgtggaacagtcctttagagaacgctctaatttggatgggtggttgtcgaccatcttctttctttaggctcgtttatgctttgtgtgggtcacaaactgagatccgtgtgactcagtttctccgcaacatcgacggctacgaatcttcaggtggtggcggcggtgcatcacttagcgacttaagtgcggagcagctagctaaaatcaatgtgttgcatgtaaaaattatagacgaagaagagaagatgaccaagaaagtctcaagcctacaagaagacgcagcggatattcccatcgccactgtggcttacgagatggagaatgtcggagagcctaacgtagtggtggatcaagctctcgacaagcaagaagaagctatggctcgtttattggtcgaggccgataatctaagggttgatactttagcgaagatcctcgggattctatctccggtacaaggagcggatttcttgctcgctgggaaaaagcttcatctttcgatgcatgagtggggaactatgagagatcgtcgccgtcgtgactgtatggttgacaccgaagtaatattcgatgcatgtacaactgtgaatagtggcccacgccccacggagacgacaaataatgagagaaattga

SEQ ID NO: 93 - protein, 291 aa, Arabidopsis thaliana
MGSSSKNIEQAQDSYLEWMSLQSQRIPELKQLLAQRRSHGDEDNDNKLRKLTGKIIGDFKNYAAKRADLAHRCSSNYYAPTWNSPLENALIWMGGCRPSSFFRLVYALCGSQTEIRVTQFLRNIDGYESSGGGGGASLSDLSAEQLAKINVLHVKIIDEEEKMTKKVSSLQEDAADIPIATVAYEMENVGEPNVVVDQALDKQEEAMARLLVEADNLRVDTLAKILGILSPVQGADFLLAGKKLHLSMHEWGTMRDRRRRDCMVDTEVIFDACTTVNSGPRPTETTNNERN

SEQ ID NO: 94 - DNA, 867 bp, Arabidopsis thaliana
atggctagaaacagtgacaatgatatgtgcaaagaagaacggaagagagagagcttcttcaaggttctacagagagttgatatttcttctgagaacatgagagcacttccttacgactttgtgagaagcttctccaacaatgagctctctcgtaagatgaagataaaagctcgatggggaagttcttgggaagtagaaatctgcaaaaatccaagattctatttcatggagaaatccggatgggagaagtttgtgagtgacaatgccttgggagccagtgagtttcttaccttcactcacaaagggaatatgcgttttacagtgaacatcttcatgcaagatggcaaggagatgctacagcctccacaatccatgtccttcatggcttcttctaggccacctaaaagagaacaaggaataccttctcttgccacgacaatagcagctgaatctaatggaggagggaactacaaaaggaagctcaactttgagaagaagaaagctgaggaatctcacaattccaagaggaccgataaagtctttagtgtccagagagaatctgcaggtgcctcttcatcttctgttgcagaattctccatgtttatcaaaaaatcatacctcatctacatgtggttcccgaaatctgttcaaagtattcatatgccgaagcagagaacgattttcaagatacatcacccaaatatgaagaagtcatggaatgtggtttacgtggtgtcagggacgaaatcaagcttctctgctggatggaaaggtttggctcaagaatatcctctagcagttggagacacttgcaagttttcattcatcaaacaacacgagctgattctctttgtctcaaaaccctaa

SEQ ID NO: 95 - protein, 288 aa, Arabidopsis thaliana
MARNSDNDMCKEERKRESFFKVLQRVDISSENMRALPYDFVRSFSNNELSRKMKIKARWGSSWEVEICKNPRFYFMEKSGWEKFVSDNALGASEFLTFTHKGNMRFTVNIFMQDGKEMLQPPQSMSFMASSRPPKREQGIPSLATTIAAESNGGGNYKRKLNFEKKKAEESHNSKRTDKVFSVQRESAGASSSSVAEFSMFIKKSYLIYMWFPKSVQSIHMPKQRTIFKIHHPNMKKSWNVVYVVSGTKSSFSAGWKGLAQEYPLAVGDTCKFSFIKQHELILFVSKP

SEQ ID NO: 96 - DNA, 5772 bp, Arabidopsis thaliana
atggcacagagtagtacatctcatgactcaggccctcaggggctcatgagacggccatctcgtagtgctgccacaacagtgtctattgaagtttttgatcatgaggtggttccggcctcccttggtaccattgctcctattctgcgtgttgctgcagagattgaacatgagcgccctcgtgttgcctatctctgtcggttttatgcatttgagaaagctcacaggttggatccaagctctggtggtcgaggtgtgaggcagtttaagacacttctctttcaaagattagaaagggacaatgcttccagtcttgcttctagggtgaaaaaaactgatggacgggaagttgagagcttctatcaacaatattatgagcactatgtcagggcacttgatcaaggagatcaagcagacagagctcagcttggtaaagcataccagacggctggagtgctctttgaagtgctcatggcagttaacaagagcgagaaagttgaagcagtagctcctgagattattgcagctgctagagatgtccaagaaaagaacgaaatttatgcaccctacaacattcttcctttggattctgctggggcctcgcagtctgttatgcagcttgaggaggtcaaagccgctgtagctgctttggggaacactcgtggattgaactggccatctgggtttgagcagcaccgaaagaaaaccggaaatctggatcttcttgactggttaagagctatgttcggattccagagagacaatgtcagaaaccagagggaacatctggtttgtttatttgctgataatcacataagattgactcccaagccagaacctctgaacaagctcgatgacagagccgttgatactgtcatgtcaaagctctttaagaactacaagaattggtgcaaatttttaggacgtaaacacagtttaaggcttcctcaagctgctcaagatatacaacagcggaagatactatatatgggcttgtatcttctcatctggggagaagctgcaaatattcgcttcatgccagaatgcttgtgctatattttccacaatatggcttatgaactccatggtctcttggctggaaatgtcagcatcgttaccggagaaaatattaagccttcttacggtggagatgatgaggcatttttaaggaaggtcattacaccaatctaccgtgtagttcaaacggaagcaaacaagaatgcaaatggcaaggctgctcactcagattggtccaactatgatgatctgaacgaatatttctggactcctgattgcttctctcttggctggccaatgcgtgatgatggggatcttttcaaatcaacccgtgatacgacacagggaaagaaaggatcgtttagaaaagcaggacgcacaggcaaatcaaatttcaccgaaactcggacattttggcacatatatcatagttttgaccgactctggacattctatctattagccctgcaggcaatgatcattctagcatttgaacgagtagagctgagagaaatcttacgcaaagatgttttatatgctctctcaagtatcttcatcacagcagcttttctgcgcttccttcagagtgtcctggacgttatcttaaacttcccaggtttccacaggtggaaatttactgatgttttgagaaatattctcaagatcgttgtcagtctcgcttggtgtgttgtgttacccctttgctatgcccagtctgtctcttttgctcctgggaagctgaaacaatggctatcatttcttccacaagttaaaggcgttcctcctctttatatcatggctgttgcactgtacttgcttccaaatgtactggcagctatcatgttcatttttccaatgcttcgacgctggatcgagaattcagactggcatatatttagattgcttctgtggtggtcacagccaagaatttatgttggaagagggatgcatgaaagtcaaattgcactcataaagtatacgattttctggctgttgcttttctgctgcaaatttgcattcagctactttctacaggtgaaacttttggtgaagccaactaacgcaattatgagcattcgccatgtaaaatacaaatggcatgagtttttccccaatgctgagcacaactatggagctgtggtgtcactctggttaccagtaattctggtttactttatggacactcaaatttggtatgctattttctccactatatgtggtggtgtcattggggcctttgatcgtttgggagagatacgaacgcttggaatgctaaggtcaaggttccaatcattacctggtgcatttaatacgtacctggttccttctgataaaacaaggagaagagggttttccttgtcaaaaagatttgcagaggtcactgcagcaagaagaactgaagcggcaaaattctcccaactctggaatgaaatcatttccagcttccgagaggaagatctaatcagtgacagggagatggatctgttgcttgttccttatacttcagaccctagtttgaaactaattcagtggccaccatttttgcttgcaagcaagataccgatagcattggatatggcagctcagtttcgaacaagagattctgacctctggaagcgcatatgcgcagacgaatatatgaaatgtgctgtcattgaatgctacgaatctttcaaacatgtcttgcacaccttggtaattggggagaatgagaaaaggattattggtattatcatcaaagaggtggagagcaacatatcaaagaattccttcctttcgaatttcagaatggcgcctttacctgctctttgtagtaaatttgtcgagcttgttggaattttgaaaaatgcggacccagcgaaaagagacacagtggtgctattgttgcaagatatgttagaagtagtgactcgagatatgatgcaaaatgaaaaccgtgaattggtagaacttgggcatactaacaaggaatccggaaggcaactctttgctggtactgacgcaaagcctgctatactgtttcctccagtggcaacagctcaatggcatgaacagataagtcgccttcatttacttttgacggtaaaagaatctgcaatggatgttccaacaaaccttgaagcacaaagaaggattgccttcttcacaaattcactgtttatggatatgccacgagctcctcgtgtcagaaatatgctgtccttcagtgttctgactccgtactatagtgaggaaaccgtctactctaagaacgacctggaaatggagaatgaagatggtgtatcagttgtatactatttgcagaagatctttccagatgagtggactaacttcttggagcggcttgattgtaaagatgaaacttctgttttggagagtgaagaaaatatattgcagcttcgccattgggtttctttgaggggacagactttgtttagaacagttagaggaatgatgtattacaggcgggcattaaagcttcaggcttttcttgacatggctaatgaaacagaaatattagcagggtacaaagccatttcagagccaactgaggaggacaagaaaagtcagagatccttgtacactcagttagaggcagtggcagatctcaaatttacttatgttgctacctgtcagaattatggaaatcagaagcgaagtggagaccggagagctactgacatcttgaacctgatggttaacaatccctctctccgtgtagcatacattgatgaggttgaggaacgagaaggcggaaaagtgcagaaagttttctactcggtgcttatcaaggctgttgataatcttgatcaggaaatatatcggataaaactacctggaccagcaaaaattggagaaggaaaacccgaaaatcagaatcatgctctcatttttactagaggagaagctctccaggctattgacatgaatcaggaccattacttggaagaagcacttaaaatgaggaatctgctggaagagttcaatgaagaccatggagtacgtgcacccactattcttggtttcagagagcatatttttactggcagtgtttcttctttagcctggtttatgtcaaatcaggaaacaagttttgtgaccattggtcagcgagtcctggcaagtcctttgaaggtaaggtttcactatggacaccctgatgtcttcgatagaatcttccacatcactcggggtggcatcagcaaagcttcacggggcataaatcttagcgaggatatctttgctggtttcaactcaactctgaggcgtggtaatgtcacccatcatgagtacatccaagtagggaaaggaagagatgttggtttgaaccagatatcactctttgaagccaaggttgcttgtggaaacggagagcaaacattgagtagggatctctaccgacttgggcatcgttttgactttttccgcatgatgtcttgttatttcacaactgtaggcttctacatcagctcgatgattgttgtcctcacagtttatgcattcttgtatggaagactttacttgtcattgagtggagtggaagaggcgatagtaaagtttgcagcagcgaaaggagatagttctcttaaggcagcgatggcgtcacagtccgtagtgcaattgggtctgctgatgacactaccaatggtgatggagattgggctagagagaggattcagaacggcgttgtctgatctaatcataatgcagcttcagttagcgcctgtcttcttcaccttctcacttggaacaaaggttcattactatggtcggaccatcctacatgggggatcaaagtacagagcaacagggcgtgggtttgtggtgaagcacgagaagtttgcagagaactacagaatgtattcgagaagccactttgtgaaaggaatggagctgatggtgctgctgatatgttacaggatttatgggaaagcagcagaggactcggtgggttatgcgcttgtcatgggctcaacatggttcctggtgggttcctggttgttcgccccattctttttcaatccctcgggattcgagtggcagaagatagttgatgactgggatgattggaacaagtggataagcagcagaggaggtatcggagtaccagcaaacaaaagctgggaatcatggtgggaagaggaacaagagcatcttcttcactctgggtttttcggaaagttctgggagatatttctctcactgcggtacttcatttaccagtatggtattgtgtaccaattgaacttgaccaaggagagccgaatgggaaaacagcacagcatcattgtgtatggactgtcttggctggtgatcgtggcagtgatgatagtcctcaagatagtgtcgatggggagaaagaagttcagtgctgatttccagcttatgttcaggcttttgaagctgtttctgttcataggatcagtggtgatcgtggggatgctattccacttcttgaagctgaccgtgggagacataatgcagtctctgttggcgtttttacccacgggatgggctctccttcagatatcacaagtggcgaggccattgatgaagacagtaggaatgtggggatcggtcaaggccttggctagagggtatgagtacatcatgggagttgttatcttcatgccagttactgtactcgcgtggttccctttcgtctctgagttccagacaaggcttctcttcaatcaagcctttagccgtggtctccagatccaacgtattctcgccggtggtaagaagcagaaataa

SEQ ID NO: 97 - protein, 1923 aa, Arabidopsis thaliana
MAQSSTSHDSGPQGLMRRPSRSAATTVSIEVFDHEVVPASLGTIAPILRVAAEIEHERPRVAYLCRFYAFEKAHRLDPSSGGRGVRQFKTLLFQRLERDNASSLASRVKKTDGREVESFYQQYYEHYVRALDQGDQADRAQLGKAYQTAGVLFEVLMAVNKSEKVEAVAPEIIAAARDVQEKNEIYAPYNILPLDSAGASQSVMQLEEVKAAVAALGNTRGLNWPSGFEQHRKKTGNLDLLDWLRAMFGFQRDNVRNQREHLVCLFADNHIRLTPKPEPLNKLDDRAVDTVMSKLFKNYKNWCKFLGRKHSLRLPQAAQDIQQRKILYMGLYLLIWGEAANIRFMPECLCYIFHNMAYELHGLLAGNVSIVTGENIKPSYGGDDEAFLRKVITPIYRVVQTEANKNANGKAAHSDWSNYDDLNEYFWTPDCFSLGWPMRDDGDLFKSTRDTTQGKKGSFRKAGRTGKSNFTETRTFWHIYHSFDRLWTFYLLALQAMIILAFERVELREILRKDVLYALSSIFITAAFLRFLQSVLDVILNFPGFHRWKFTDVLRNILKIVVSLAWCVVLPLCYAQSVSFAPGKLKQWLSFLPQVKGVPPLYIMAVALYLLPNVLAAIMFIFPMLRRWIENSDWHIFRLLLWWSQPRIYVGRGMHESQIALIKYTIFWLLLFCCKFAFSYFLQVKLLVKPTNAIMSIRHVKYKWHEFFPNAEHNYGAVVSLWLPVILVYFMDTQIWYAIFSTICGGVIGAFDRLGEIRTLGMLRSRFQSLPGAFNTYLVPSDKTRRRGFSLSKRFAEVTAARRTEAAKFSQLWNEIISSFREEDLISDREMDLLLVPYTSDPSLKLIQWPPFLLASKIPIALDMAAQFRTRDSDLWKRICADEYMKCAVIECYESFKHVLHTLVIGENEKRIIGIIIKEVESNISKNSFLSNFRMAPLPALCSKFVELVGILKNADPAKRDTVVLLLQDMLEVVTRDMMQNENRELVELGHTNKESGRQLFAGTDAKPAILFPPVATAQWHEQISRLHLLLTVKESAMDVPTNLEAQRRIAFFTNSLFMDMPRAPRVRNMLSFSVLTPYYSEETVYSKNDLEMENEDGVSVVYYLQKIFPDEWTNFLERLDCKDETSVLESEENILQLRHWVSLRGQTLFRTVRGMMYYRRALKLQAFLDMANETEILAGYKAISEPTEEDKKSQRSLYTQLEAVADLKFTYVATCQNYGNQKRSGDRRATDILNLMVNNPSLRVAYIDEVEEREGGKVQKVFYSVLIKAVDNLDQEIYRIKLPGPAKIGEGKPENQNHALIFTRGEALQAIDMNQDHYLEEALKMRNLLEEFNEDHGVRAPTILGFREHIFTGSVSSLAWFMSNQETSFVTIGQRVLASPLKVRFHYGHPDVFDRIFHITRGGISKASRGINLSEDIFAGFNSTLRRGNVTHHEYIQVGKGRDVGLNQISLFEAKVACGNGEQTLSRDLYRLGHRFDFFRMMSCYFTTVGFYISSMIVVLTVYAFLYGRLYLSLSGVEEAIVKFAAAKGDSSLKAAMASQSVVQLGLLMTLPMVMEIGLERGFRTALSDLIIMQLQLAPVFFTFSLGTKVHYYGRTILHGGSKYRATGRGFVVKHEKFAENYRMYSRSHFVKGMELMVLLICYRIYGKAAEDSVGYALVMGSTWFLVGSWLFAPFFFNPSGFEWQKIVDDWDDWNKWISSRGGIGVPANKSWESWWEEEQEHLLHSGFFGKFWEIFLSLRYFIYQYGIVYQLNLTKESRMGKQHSIIVYGLSWLVIVAVMIVLKIVSMGRKKFSADFQLMFRLLKLFLFIGSVVIVGMLFHFLKLTVGDIMQSLLAFLPTGWALLQISQVARPLMKTVGMWGSVKALARGYEYIMGVVIFMPVTVLAWFPFVSEFQTRLLFNQAFSRGLQIQRILAGGKKQK

SEQ ID NO: 98 - DNA, 813 bp, Arabidopsis thaliana
atgaaaatcctctcactttcactactcttgctcttggccgctacggtctcccacgtccagtcttcggcatccgttccagggctcatcgaactcctcgaatcgaacaccatctttgggaacgaagccgaactcttagagaaagagggactgtccatcaactaccccaactgcagaagctggcaccttggtgttgagacctctaacatcataaacttcgacacggtgcccgcaaattgcaaagcctatgttgaagactacttgatcacttccaaacagtaccaatacgactccaaaactgtaaacaaagaggcatatttttacgccaaaggacttgccctaaagaacgataccgtcaatgtttggatctttgacctagacgacactctcctctctagtattccctactacgctaaatatggatatgggaccgagaacacagccccgggggcgtactggtcgtggttagagtccggagaatcaactccaggactcccggagaccttgcatctatacgaaaacctcttggaactcgggattgaacccatcataatctctgacagatggaaaaaattgtcagaagtcactgtcgagaatctcaaggctgttggtgtaacaaaatggaagcatctcatactcaagccaaacggatcgaagttgacgcaagtggtgtacaagtcaaaggttaggaatagccttgtgaagaaagggtacaacatcgttgggaatattggagaccaatgggctgatttggttgaggatactcctggaagggtttttaagctcccaaatccactctactacgtaccttcttaa

SEQ ID NO: 99 - protein, 270 aa, Arabidopsis thaliana
MKILSLSLLLLLAATVSHVQSSASVPGLIELLESNTIFGNEAELLEKEGLSINYPNCRSWHLGVETSNIINFDTVPANCKAYVEDYLITSKQYQYDSKTVNKEAYFYAKGLALKNDTVNVWIFDLDDTLLSSIPYYAKYGYGTENTAPGAYWSWLESGESTPGLPETLHLYENLLELGIEPIIISDRWKKLSEVTVENLKAVGVTKWKHLILKPNGSKLTQVVYKSKVRNSLVKKGYNIVGNIGDQWADLVEDTPGRVFKLPNPLYYVPS

SEQ ID NO: 100 - DNA, 1338 bp, Arabidopsis thaliana
atggcgagcaacggagttaccaactgtaacgcaaacgccaatgtttggcggttcaaaggaaacggtgcaacgagtgatgcggcggcggtgacgttgagaaagcttgcttttgggatgtttaaaaactgcaccatgaacagtggaaagaccattttgttcccaactcccggcgagccctccgcccattccaacttcaggacttgcccggaagccgaggaagccgttgccgcagctgcacgctccggcatggctaactcttacgcacccagccctggagttttcaaggctagaagggcggtggctgaatatttaaacggagaacttccgacgaagctgaaggccgaggatgtgtatatcaccggaggatgtaaccaagccatagagatcgtgatagattctcttgccggaaatccatccgccaacattctacttccaaggccgggatatcctcactacgatgctcgtgctgtctatagcggcctcgagattcgcaaatacgatcttctccccgagagtgattgggaaatcaatctcgatggcctcgaggcggctgcggatgagaataccgtcgcaatggtaatcatcaaccccaacaatccatgtggaaacgtctacacctacgaccatctcaacaaggtcgcggagatggctagaaaactcggtataatgataatatccgacgaagtatatgatcatgttgtatatggagacaagccttttattcccatggggaagtttgcatcaatagctccggtgatcacgctcggatccatatccaaaggatgggtcaacccaggctggagagttggctggatcgccatgaacgatcctaatggtatctttgtatctacaggggtagttcaagcaatagaggattttcttgatttaactccacagccttcatttattctccaggaagcacttcctgatatattggagaaaacacctaaagagttcttcgagaagaagatcaaagccatgagacgcaacgtcgagctttcatgtgagaggctcaaggatattccttgtctcttttgtcccaagaaacccgaatcttgttcttatttatggttgaagcttgacacatcaatgttgaataatatcaaaaatgattttgatttctgcacgaagctagttagtgaggagagtcttatccttataccaggagtggctctaggggcagagaattgggtgaggatatcgataggaaccgacgaatcagtggtacaagaaatatttgacagactaaaaggtttctatgatcgtcatgccatctccaaggaagctatcaaactcagtggccatgccattaaccagatcgtcgtctctgtcaactga

SEQ ID NO: 101 - protein, 445 aa, Arabidopsis thaliana
MASNGVTNCNANANVWRFKGNGATSDAAAVTLRKLAFGMFKNCTMNSGKTILFPTPGEPSAHSNFRTCPEAEEAVAAAARSGMANSYAPSPGVFKARRAVAEYLNGELPTKLKAEDVYITGGCNQAIEIVIDSLAGNPSANILLPRPGYPHYDARAVYSGLEIRKYDLLPESDWEINLDGLEAAADENTVAMVIINPNNPCGNVYTYDHLNKVAEMARKLGIMIISDEVYDHVVYGDKPFIPMGKFASIAPVITLGSISKGWVNPGWRVGWIAMNDPNGIFVSTGVVQAIEDFLDLTPQPSFILQEALPDILEKTPKEFFEKKIKAMRRNVELSCERLKDIPCLFCPKKPESCSYLWLKLDTSMLNNIKNDFDFCTKLVSEESLILIPGVALGAENWVRISIGTDESVVQEIFDRLKGFYDRHAISKEAIKLSGHAINQIVVSVN

SEQ ID NO: 102 - DNA, 1449 bp, Arabidopsis thaliana
atgcaaatctcatcttcatcgtcttcaaatttcttctcttctctttatgctgatgaaccggcactaatcacattaacaattgttgtagtagtagtagtgttactatttaaatggtggttgcactggaaagagcaaagactacggctacctcctggctccatggggttgccttacatcggagagacactccgcctctacacagaaaatcccaattccttcttcgccactcgccaaaacaagtacggggatatattcaagacgcacatattaggatgtccatgtgtgatgataagtagtccagaggcggctcgaatggtgttagtgagcaaagctcacttgttcaagccaacttatcctccaagcaaagagcgtatgattggaccagaggctcttttcttccaccaaggtccataccattctacccttaagcggctggtccagtcttctttcatgccttctgctctcagaccaaccgtctctcacatcgagctccttgtcctccaaaccctttcctcttggacgtcccaaaagtccatcaacaccctcgaatacatgaaacgatatgcattcgatgtggcgatcatgtcagcgttcggggacaaagaggagcccactacgattgatgttattaagcttctctatcaacgtctcgaaaggggttacaactccatgcctctcgacctaccgggcacactttttcataagtccatgaaggcaagaatagaattaagcgaggaactaaggaaagtaatagagaagagaagagagaatgggagagaagaaggaggactattgggagtacttctgggagcaaaggatcaaaaacgcaacggcttaagtgattcacagattgctgacaacatcatcggtgttatattcgccgccaccgacaccaccgcttctgtcttaacttggcttctcaagtacttacacgaccaccccaatctcctccaagaagtctccagggagcaattcagcattcgacagaaaataaaaaaagaaaaccgaagaatctcatgggaagatacaagaaaaatgccactgaccactagggtgatacaagagacactaagagcagcaagtgtactgtcctttacatttagagaagcagtacaagacgtcgaatatgatggctacttgatcccaaagggttggaaggttcttcctcttttccggcgaatccatcactcctccgaattcttccccgatcctgaaaaattcgatccttctagattcgaggtggcaccaaaaccttacacgtacatgccattcggaaatggagtgcactcatgtccaggaagtgagctggctaaacttgagatgcttatcctccttcaccacctcactacttccttcagatgggaagtgattggagatgaagaaggtatacagtatggtcctttccctgtacccaagaagggtttaccaataagagtaaccccgatttaa

SEQ ID NO: 103 - protein, 482 aa, Arabidopsis thaliana
MQISSSSSSNFFSSLYADEPALITLTIVVVVVVLLFKWWLHWKEQRLRLPPGSMGLPYIGETLRLYTENPNSFFATRQNKYGDIFKTHILGCPCVMISSPEAARMVLVSKAHLFKPTYPPSKERMIGPEALFFHQGPYHSTLKRLVQSSFMPSALRPTVSHIELLVLQTLSSWTSQKSINTLEYMKRYAFDVAIMSAFGDKEEPTTIDVIKLLYQRLERGYNSMPLDLPGTLFHKSMKARIELSEELRKVIEKRRENGREEGGLLGVLLGAKDQKRNGLSDSQIADNIIGVIFAATDTTASVLTWLLKYLHDHPNLLQEVSREQFSIRQKIKKENRRISWEDTRKMPLTTRVIQETLRAASVLSFTFREAVQDVEYDGYLIPKGWKVLPLFRRIHHSSEFFPDPEKFDPSRFEVAPKPYTYMPFGNGVHSCPGSELAKLEMLILLHHLTTSFRWEVIGDEEGIQYGPFPVPKKGLPIRVTPI

SEQ ID NO: 104 - DNA, 1236 bp, Arabidopsis thaliana
atgtcgggagcatcttctgtttcttctatttgttcctctaatgtatcattgatccctacgggacctcaagtgttcatcaatttccgggggaaagatttacgaaaaggcttcatgagctttcttaagcctgctttgaaaaaagaaaagatcaacgtgtttattgacgaacaagaggagaggggcaaatacctaatcagtctttttgatacgataggtgagtcgaaaatcgctttggttatcttttctgaaggatactgcgagtcacattggtgtatggacgagctggtgaaaatcaaggaatacatggatcaaaacagactcataatcattccaatattctacaggcttgatctcgatgtggtaaaagatcttacaggaaaatttggcgataatttttgggatttggtagataaatatcaacctgaaccaaaaaagctccataaatggacggaagctttgttctctgtttgcgaattgttttccttgatcttaccaaaacacagtgacatttcggatagagattttgtaaagtcaatcgtcaaggctgttaaaaaagtgcagaagaatttcttccaacgaagaaatggagaaatagaatatcaagatttctcagtccctgcatgtaaactcactatcactatgcacgagtcaccaaatgaggaagccgttcaagttacggtgctaaatgaattttaccagatgaagaatcagtcaccagtgccctcatacgagttcaaattttgggtcgaccttacgagaccaaagggtaacgttttcatgattgacgcaagagatctttccattgcatggtcagaggactccaaccattggacctggctccctctcccaaaccaaaattcaaatgaatcagtgatggaaattgcatttttgaaaagtgctagctggctagacgtagctggaaagtttgacactcgatatttgaccccgaggacaaggtacgaggtggtgttcgtagtgaagttagaatacacattcgaatgggagacactagtgaagctaaagctagacttgccgaatacttgggagaaaccgcaagaacagagtgtggacatgtttgactacataagtgaccaatggctcgatattccagttggagagttcaccacatcgaagaaaaacgtcggggaaatctcttttgcaatgtacgaacacgagtgccaactgtggaagtcaggcctcttcgtcaaaggtgttacaattcgtcccaaatactaa

SEQ ID NO: 105 - protein, 411 aa, Arabidopsis thaliana
MSGASSVSSICSSNVSLIPTGPQVFINFRGKDLRKGFMSFLKPALKKEKINVFIDEQEERGKYLISLFDTIGESKIALVIFSEGYCESHWCMDELVKIKEYMDQNRLIIIPIFYRLDLDVVKDLTGKFGDNFWDLVDKYQPEPKKLHKWTEALFSVCELFSLILPKHSDISDRDFVKSIVKAVKKVQKNFFQRRNGEIEYQDFSVPACKLTITMHESPNEEAVQVTVLNEFYQMKNQSPVPSYEFKFWVDLTRPKGNVFMIDARDLSIAWSEDSNHWTWLPLPNQNSNESVMEIAFLKSASWLDVAGKFDTRYLTPRTRYEVVFVVKLEYTFEWETLVKLKLDLPNTWEKPQEQSVDMFDYISDQWLDIPVGEFTTSKKNVGEISFAMYEHECQLWKSGLFVKGVTIRPKY

SEQ ID NO: 106 - DNA, 1665 bp, Arabidopsis thaliana
atggtgatgcgtacgatgaaagatctccataagctctgtcctgagatcattgacagctcccaaatcctcgaaatgagacgtgaagaagttgacaaggtgttagctgcattagatggactgattaaggggatgaacgagaggcttaatacgacagagaacggcaatgtggaaatgaagaaaaaggttagtccgcggagtactaaaacatcaaatgaccgatcagaatcattggcgaagcaaccgatcaggccaaaaacggtgctgagtccaccgagtaaagtccatggagacttttcaatctctgtgtcaaatcttcctagaaatgtgagaatgcaagcgcttgtaaagctgagtcctatcgatgtaaagcgactcgctatccaaaattttagtcagaaagaagctctgagcaataatggtgatggtgatgatgagagtctcaaagtgaagaagagtgaaacagaggagaaagcaaaagaagctattcttgagaaacaagatagtgtgaagagtcagattgatgataaagattgctcaaaagtttcagtgaaatctgaaatggtttcaaaatcttttgctccgcctcctccaccacctccagggaatgcagcaatcccggtggaaccaccacttacaatgtctgctgaaaaagagtcgtatgctccgcttcctccacctcccggaagagcagcactaccaccgccaccgccacttccaatggctgtgagaaaaggagtggctgctccgcctcttccacctccagggactgcagcactacctccaccaccgccacttccaatggctgccggaaaaggagtggctgctccaccacctcctccacctggcgcaagaggaggcttgggagcgaagaaagtaactagtaaactgaagagatcaacccatttaggggccctatttagattcctcaaggggaaactagaagggaagaatccagaagtaagatctcgtggcgctggaggaggaagtaaaggcgcgactggaagcgctccagccagcggaaagcaaggaatggctgatgctcttgctgagataacaaagaagtctccttattttcagaagatagaagaggatgttcgaatgtatatgacttcaatcaatgagcttaagacagatattacaaagttcaagaacaaggacattaccgagcttcaaaaatttcaccatcgtattgaatcagttcttgagaaactagaagatgaaacacaggttctagcaagatgtgaaggattcccgcataagaaactcgaagcaataagaatggctgctgcattatactcgaagctggagggtatgatcaaagagctaaagaactggaagatagagtctccggcgaaccaactttacgataagactgagcgttactttgcaaaggcaagtcatagaaatactgattttcgcttgtttcttcgcctttctttttttctggaaaagagagaagcaaagattgcatcgcaaactactgcagaatcactcgaggcaaagccaagcacgaagaataagactccaggatgggctaaaacgttgtggagggcatttcattttgcatacagagtttacacatttgctggtgggcacgacgatcgtgctgataagcttacaagagagttggctgaggagatcgagcagattcttggaaaccaatga

SEQ ID NO: 107 - protein, 554 aa, Arabidopsis thaliana
MVMRTMKDLHKLCPEIIDSSQILEMRREEVDKVLAALDGLIKGMNERLNTTENGNVEMKKKVSPRSTKTSNDRSESLAKQPIRPKTVLSPPSKVHGDFSISVSNLPRNVRMQALVKLSPIDVKRLAIQNFSQKEALSNNGDGDDESLKVKKSETEEKAKEAILEKQDSVKSQIDDKDCSKVSVKSEMVSKSFAPPPPPPPGNAAIPVEPPLTMSAEKESYAPLPPPPGRAALPPPPPLPMAVRKGVAAPPLPPPGTAALPPPPPLPMAAGKGVAAPPPPPPGARGGLGAKKVTSKLKRSTHLGALFRFLKGKLEGKNPEVRSRGAGGGSKGATGSAPASGKQGMADALAEITKKSPYFQKIEEDVRMYMTSINELKTDITKFKNKDITELQKFHHRIESVLEKLEDETQVLARCEGFPHKKLEAIRMAAALYSKLEGMIKELKNWKIESPANQLYDKTERYFAKASHRNTDFRLFLRLSFFLEKREAKIASQTTAESLEAKPSTKNKTPGWAKTLWRAFHFAYRVYTFAGGHDDRADKLTRELAEEIEQILGNQ

SEQ ID NO: 108 - DNA, 909 bp, Arabidopsis thaliana
atggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatag

SEQ ID NO: 109 - protein, 302 aa, Arabidopsis thaliana
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 110 - DNA, 1539 bp, Arabidopsis thaliana
atgggagccttggaagcagaaagagccgccaacaatgctacggcgttagagacacagtcgtcaccggaagatctcggtcaaccatctcctctgcgtaagatcatctccgtcgcttcaatcgccgccggtgtacagttcgggtgggccttacagctttctcttctgactccttacatacaactcctcgggatccctcacaaatggtcgtcttacatgtggctttgtggtcctatctccggcatgattgttcaaccgatcgtcggttaccacagtgaccgatgcgagtccagattcggtcgccgtcgtcctttcattgccgccggagtcgcactcgtagccgtctcggttttccttatcggattcgcggcggatatgggacatagttttggagataaactcgagaacaaggtaaggactcgagccattataatcttcctaaccgggttttggttcctcgacgtggctaacaacaccttacaaggaccatgccgtgctttcttagccgatttagccgccggagacgctaaaaaaacgcgagtcgcaaacgcgtgtttctccttctttatggcggttggaaacgttttgggttacgctgctggatcttacactaaccttcacaaaatgtttcctttcacaatgacaaaagcttgcgacatctattgtgcgaatctcaagacttgtttcttcttatccatcactctcctccttatcgtcacattctcgtctctatggtacgttaaagacaaacaatggtctccacctcaaggagacaaggaggagaaaacatcaagtctttttttctttggagaaatctttggagctgttagacacatgaaacgtcccatggtgatgcttctaattgtcacggtcattaattggatcgcttggtttccatttattttgtatgataccgattggatgggtcgtgaagtgtacggtggaaactcagatggagatgaacgatcgaagaaactttacgaccaaggagttcaggctggtgcattgggattgatgtttaattctatacttcttggtttcgtgtcacttggtgttgaatcgattggtcggaaaatgggaggagctaaacgactttggggatgtgtgaatttcatactcgccataggtttggccatgacggttcttgttactaaatcggctgagcatcaccgggaaatcgccggtcctttagccggaccgagcagtggtattaaagccggagtatttagtctctttaccgttcttggtatcccattggccattacttacagtattccatttgcactagcgtccattttctcaaccaattccggtgccggccaaggactttcattaggcgttttaaatatagcgatttgtataccacaaatgatagtatcattctcaagtggaccattggacgctcaattcggcggtggaaacctaccttcatttgtggtcggagcaattgccgcggcggttagtggagtcttagcgttaaccgttttaccttcaccgcctccggacgcaccagccatgtcaggggctatgggattccattag

SEQ ID NO: 111 - protein, 512 aa, Arabidopsis thaliana
MGALEAERAANNATALETQSSPEDLGQPSPLRKIISVASIAAGVQFGWALQLSLLTPYIQLLGIPHKWSSYMWLCGPISGMIVQPIVGYHSDRCESRFGRRRPFIAAGVALVAVSVFLIGFAADMGHSFGDKLENKVRTRAIIIFLTGFWFLDVANNTLQGPCRAFLADLAAGDAKKTRVANACFSFFMAVGNVLGYAAGSYTNLHKMFPFTMTKACDIYCANLKTCFFLSITLLLIVTFSSLWYVKDKQWSPPQGDKEEKTSSLFFFGEIFGAVRHMKRPMVMLLIVTVINWIAWFPFILYDTDWMGREVYGGNSDGDERSKKLYDQGVQAGALGLMFNSILLGFVSLGVESIGRKMGGAKRLWGCVNFILAIGLAMTVLVTKSAEHHREIAGPLAGPSSGIKAGVFSLFTVLGIPLAITYSIPFALASIFSTNSGAGQGLSLGVLNIAICIPQMIVSFSSGPLDAQFGGGNLPSFVVGAIAAAVSGVLALTVLPSPPPDAPAMSGAMGFH

SEQ ID NO: 112 - DNA, 1389 bp, Arabidopsis thaliana
atggcgaatgcatcacagttatctccgacaaacaaacacttcttcaagcctcttctccccggattccagagaaacctcaatattcctgtgaagttcttctccgagcacatcgagggaaaacacgagggcgagactgtaaagttgagagcagatgcgtcgaagagaacatgggaagtgaagatggatggcaacagactcaccgaaggttggaaagagttcgtggaggcacatgatcttcgtatccgcgacttcgttgtctttagacacgaaggagacatggtgttccatgtcactgctttgggacctagttgctgtgagatccaatacccacagtctatcagccatgaagaaggcgaagagagtggtgaagttgaaatatccgagagagaagttgaggagaatttgcaaaaagaatatgatcagtcttcagcagatctgaattgttttagccaatccgtaacgcactcaaacatatcaaatgatcttgtgactctgcccagggatttcgcaaaacgaaacggtttagacaaaggaatgcatgagatagtattgatgaatgaagaaggaaagtcatgggaatcagaagtaaggagtagaatgtctggtcaggtttttattgttggaggttggaaaagtctctgcagcgaaaataaattaaaaggtggagattcttgcacattcaaactgctgcaaaatgcgaaaacgcccgtgtttcagctctgtagccgcatcggagaaagtcggtttgtgaagttaactcctacactaaacagccttgagattggcaaacagcatctaccggtaagtttcacgaaagggaatggactcatacatccgggggagataattctggtggacaaagacagagttgaatggtcgatgaagcttcaggttgataatagaggagggatgcatatatttggtggtaatgactggaaaagtttctgtgccgcaaatgaagtaggcgcaggggagtcactaactttggagttgattcgaggaggcttaagtcctttattcaagttcttctccaagatagagcaaccctcattcgaagcagaggataggagacacaagagagctcgagtccataatgggagccaggaaacagataagggagaaccttctcgagcaactaaaatgggaccggagcttgagaaaagggagaagacagctgaaaaaggagaaccgtctcgagcatctaacaaatccagtggtaaacaaggaaacttacagaaaacgcaagcttgctctgtcacagatcacgtggctaaggtgaaagagagcgttgtagatactttaactagtatcagacggttccaagcagagcttgaaacaatggaacagaaattagaagattcattgcaggaaatcaacaagttaagttag

SEQ ID NO: 113 - protein, 462 aa, Arabidopsis thaliana
MANASQLSPTNKHFFKPLLPGFQRNLNIPVKFFSEHIEGKHEGETVKLRADASKRTWEVKMDGNRLTEGWKEFVEAHDLRIRDFVVFRHEGDMVFHVTALGPSCCEIQYPQSISHEEGEESGEVEISEREVEENLQKEYDQSSADLNCFSQSVTHSNISNDLVTLPRDFAKRNGLDKGMHEIVLMNEEGKSWESEVRSRMSGQVFIVGGWKSLCSENKLKGGDSCTFKLLQNAKTPVFQLCSRIGESRFVKLTPTLNSLEIGKQHLPVSFTKGNGLIHPGEIILVDKDRVEWSMKLQVDNRGGMHIFGGNDWKSFCAANEVGAGESLTLELIRGGLSPLFKFFSKIEQPSFEAEDRRHKRARVHNGSQETDKGEPSRATKMGPELEKREKTAEKGEPSRASNKSSGKQGNLQKTQACSVTDHVAKVKESVVDTLTSIRRFQAELETMEQKLEDSLQEINKLS

SEQ ID NO: 114 - DNA, 1335 bp, Arabidopsis thaliana
atggccctaatggtgaacgctaaaggtggaaatggagggaaagaatgggatgatgggtttgattatgagggtgtaacaaagatacatgtccgagctggttctgaaggcattcagttcatcaagtttgactatgtcaaggttggaaaaactattgatggaccaatccatggtgtttctggccttggtatgacacaaacgtttgagattaaccatttgcaaaaggaatatctggtatctattgagggttactatgacaaatctacgggcgtgattcaatcaatccaattcaaaactaacgtgaagacttctgatatgatggggttcaacaagggtactaagttttccctaggaatcataaggaacaagatcattgggtttcatggattttctgacaagaatgtctattctcttggagcatatttcatcaaggttcttgcaaccaaatcgggaatgcaaggtggtcaaaacacagggaaaagttatgattatggtggtgactatgatggcataagaaaagtgtacgttacatatgatggcacttcaataaggcatatgagggtggactatgataaagccggtcaagtggaatgctatgagtacggggacaaaaccggaacacaatataagattacggtgaattatccatatgaatgtatcacatccgtagaaggaagctacgcaaatacccaaccttatggatgtattgtccttaggtcgttaacattcaaaacatcaaatgggaggaccttagtaattggaacagtgactggtaccaagttcttgcttgagagcaaaggaaatgctattgttgggttccatggacgggtaggttcttgtgttgatagtatcggtgcatattacgctccgttttctccttctcctccacctacacagaaactagagggacaaggtggtgatggaggagattcttgggacgatggtgctttcctaaatgtaaagaaagtatatattggacaaggctcgaacggtattgtcgccgttaagtttgagtacgagaacgacgctagtgaggttgttgttggagatgaacatggaaagactacattgcttggatacgaagtgttcgagctggattatccgaatgaatacatcacatcattggagggttgccacgacaaggtcatgggagctgaaactggagttataacaatgcttaggttcaagacaaacaaacgtacctctccaccttttggacttgaagctggtgtcaacttcgtcctccagaaggaaagtcacaagatcactgggttccatggaaagtccagtactatgcttcatcagattggggttcatgtcgttcccatcactgagtga

SEQ ID NO: 115 - protein, 444 aa, Arabidopsis thaliana
MALMVNAKGGNGGKEWDDGFDYEGVTKIHVRAGSEGIQFIKFDYVKVGKTIDGPIHGVSGLGMTQTFEINHLQKEYLVSIEGYYDKSTGVIQSIQFKTNVKTSDMMGFNKGTKFSLGIIRNKIIGFHGFSDKNVYSLGAYFIKVLATKSGMQGGQNTGKSYDYGGDYDGIRKVYVTYDGTSIRHMRVDYDKAGQVECYEYGDKTGTQYKITVNYPYECITSVEGSYANTQPYGCIVLRSLTFKTSNGRTLVIGTVTGTKFLLESKGNAIVGFHGRVGSCVDSIGAYYAPFSPSPPPTQKLEGQGGDGGDSWDDGAFLNVKKVYIGQGSNGIVAVKFEYENDASEVVVGDEHGKTTLLGYEVFELDYPNEYITSLEGCHDKVMGAETGVITMLRFKTNKRTSPPFGLEAGVNFVLQKESHKITGFHGKSSTMLHQIGVHVVPITE

SEQ ID NO: 116 - DNA, 4272 bp, Arabidopsis thaliana
atggagggaactagttttcaccaagcgagtaatagtatgagaagaaactcatcggtgtggaagaaagattcaggaagggagattttctcgaggtcatctagagaagaagacgatgaagaagctttgagatgggctgctcttgagaagcttcccacttttgatcgtctcaggaaaggaatcctaactgcctcacatgccggaggacccatcaacgagatcgatattcagaagcttgggtttcaagatactaagaaactgctagagaggctcatcaaagtcggtgacgatgagcatgagaaactcctctggaaactcaagaaacgtatcgatagagttggaatcgatcttccgacaatagaagttcggtttgatcatctaaaagttgaagcagaggttcatgttggaggcagagctttacctacgttcgtcaatttcatctccaattttgctgataagttcctgaatactctgcatcttgttccgaaccgaaagaagaagttcactatactcaacgacgtcagcggaatcgtcaagcctggcaggatggctctgcttttgggtcctccaagttctgggaaaacgaccctcttgcttgccttggcgggaaagcttgatcaagaactaaagcaaactggaagagtgacatacaatggtcatggaatgaacgagtttgtgccacaaagaacagctgcatatatcggccaaaacgatgttcatatcggtgagatgactgttcgtgagacttttgcttacgcagctcgcttccaaggtgttggttcgcgttatgacatgttgacagagttggcaagaagagagaaagaagcaaacatcaaacctgaccctgatattgatatattcatgaaggcgatgtcaacagcaggtgaaaaaacaaatgtgatgacagattatatcctcaagatcttaggacttgaggtctgtgcagacactatggtcggcgatgatatgttgagaggcatctccggaggacaaaagaagcgtgtcactactggtgaaatgctggttggaccgtctagggctctgttcatggatgagatatcgactggtttagatagttcaacgacttaccagatagtgaactccctcagaaactatgttcatatcttcaatgggacagctctgatctctctccttcagcctgcgccagagacattcaatctcttcgatgatatcattctcattgcagaaggcgagatcatctacgagggccctcgtgatcacgttgtggagttctttgagaccatgggattcaaatgtcctccaagaaaaggcgttgctgatttccttcaagaagtgacatcaaagaaagaccaaatgcagtactgggcacgacgtgatgagccttacaggttcattagagtgagagagtttgcagaggcgtttcaatcattccacgttggccggagaatcggagatgagcttgctttgccctttgacaagacaaagagccatccggctgctctaaccaccaagaaatacggagttgggattaaagaacttgtcaagaccagcttctcaagagaatacttactcatgaaaagaaactcctttgtttactacttcaagtttggacaactgctggtaatggcatttttgacaatgacgttgttctttcggacggagatgcaaaagaagactgaggttgatgggagtctctacactggagccttgttcttcatccttatgatgctcatgttcaatggaatgtctgaactttcaatgaccatagcaaaacttcctgtgttttacaaacaaagagatctcctcttctaccctgcatgggtgtactctctgcctccttggctcctcaagatacctataagcttcatggaagccgctctcacaacattcatcacttactatgtcatcggctttgatcccaacgttggaaggctgtttaagcagtatattctcctcgtgctcatgaaccaaatggcttcagcattgtttaagatggtggcagcattgggaagaaacatgatcgttgcaaatacatttggtgcatttgcgatgctcgtcttctttgccttgggtggtgtggtactttcacgagacgacattaagaagtggtggatatggggttactggatctccccaataatgtatggacagaacgcgatcctagccaatgagttctttggacacagctggagtcgagctgtcgaaaactcgagcgaaacacttggagttactttccttaagtctcgtgggttcttaccccatgcatactggtactggattggaactggagccttacttgggttcgtcgtgttattcaattttggtttcacgctggctctgacgtttctgaactccttgggaaagcctcaagctgttattgcagaagagcctgcgagtgatgagacagaacttcagtctgctaggtcagaaggtgtagttgaagctggtgccaataagaaaagagggatggtgcttccatttgagccacattcaattaccttcgacaatgttgtatactcagttgacatgccccaggaaatgatagagcaaggcacacaagaagacagacttgtcctgttgaaaggtgtgaatggtgcattcaggccaggcgtgctcacggctctcatgggtgtctctggagctggcaaaaccactctgatggatgttcttgccggaaggaaaaccggtggttatattgatggcaacatcaccatttccggttaccctaagaatcaacaaacatttgcccgtatctcaggatactgtgaacaaactgatatccattccccacatgtcactgtttacgagtccttggtttactcagcctggctccgattacctaaagaagttgataaaaacaagagaaagatattcatagaggaagtgatggagctggtggagttaacgccgctgaggcaagcactggttggactacctggtgagagcggtttgtcaacagagcaaagaaagagactgaccattgcggtggagctggttgcaaatccttccatcatattcatggatgaacctacttcaggattggatgcacgagctgctgccatcgttatgaggactgtaaggaacacagttgacactggtagaacagtcgtctgcaccattcaccagcctagcatcgacatctttgaagcctttgatgagttgttcctacttaagcgtggaggtgaggagatatacgttggacctcttggccacgaatcaacccatttgatcaactattttgagagtattcaaggaatcaacaagatcacagaaggatacaacccagcaacctggatgcttgaagtctcaaccacatctcaagaagcggctttaggagtcgatttcgcccaagtctacaaaaattcagaactttacaagagaaacaaggagctaatcaaggagctaagccagccagctccaggatcaaaagatttatatttcccaacacaatactctcaatcgttcttgacacaatgtatggcttctctatggaaacaacactggtcctactggagaaatcctccttacacagccgtgagattcctcttcacaatcggcattgctcttatgttcggcacaatgttctgggaccttggaggcaaaacgaaaacgagacaggatttatcgaatgcaatgggttcaatgtacacagctgttctcttcctcggattacaaaacgcagcttcagtgcaaccagtcgtcaacgtcgaaagaactgtcttttaccgagaacaagccgccggaatgtactccgccatgccttatgctttcgctcaggttttcatcgagatcccatacgttctcgtgcaagcgatagtgtacggtctcatagtgtacgctatgataggattcgagtggacggcggtgaagttcttctggtacctcttctttatgtacggatcattcttaactttcaccttctacggaatgatggctgtagctatgacgcctaaccaccacatcgcctccgtcgtctcctccgctttctacggcatctggaatctcttctccggcttcctcatccctcgtcccagtatgcctgtgtggtgggaatggtactactggctttgcccagttgcatggacattgtatggattaatcgcatcacagttcggtgatattacagaacctatggcagatagtaatatgagtgtgaagcaattcattagagaattctatggatatagagaaggtttcttgggtgtggttgccgccatgaacgtcatctttcctttgctctttgccgttatctttgctatcggaatcaagagtttcaatttccaaaaacgatag

SEQ ID NO: 117 - protein, 1423 aa, Arabidopsis thaliana
MEGTSFHQASNSMRRNSSVWKKDSGREIFSRSSREEDDEEALRWAALEKLPTFDRLRKGILTASHAGGPINEIDIQKLGFQDTKKLLERLIKVGDDEHEKLLWKLKKRIDRVGIDLPTIEVRFDHLKVEAEVHVGGRALPTFVNFISNFADKFLNTLHLVPNRKKKFTILNDVSGIVKPGRMALLLGPPSSGKTTLLLALAGKLDQELKQTGRVTYNGHGMNEFVPQRTAAYIGQNDVHIGEMTVRETFAYAARFQGVGSRYDMLTELARREKEANIKPDPDIDIFMKAMSTAGEKTNVMTDYILKILGLEVCADTMVGDDMLRGISGGQKKRVTTGEMLVGPSRALFMDEISTGLDSSTTYQIVNSLRNYVHIFNGTALISLLQPAPETFNLFDDIILIAEGEIIYEGPRDHVVEFFETMGFKCPPRKGVADFLQEVTSKKDQMQYWARRDEPYRFIRVREFAEAFQSFHVGRRIGDELALPFDKTKSHPAALTTKKYGVGIKELVKTSFSREYLLMKRNSFVYYFKFGQLLVMAFLTMTLFFRTEMQKKTEVDGSLYTGALFFILMMLMFNGMSELSMTIAKLPVFYKQRDLLFYPAWVYSLPPWLLKIPISFMEAALTTFITYYVIGFDPNVGRLFKQYILLVLMNQMASALFKMVAALGRNMIVANTFGAFAMLVFFALGGVVLSRDDIKKWWIWGYWISPIMYGQNAILANEFFGHSWSRAVENSSETLGVTFLKSRGFLPHAYWYWIGTGALLGFVVLFNFGFTLALTFLNSLGKPQAVIAEEPASDETELQSARSEGVVEAGANKKRGMVLPFEPHSITFDNVVYSVDMPQEMIEQGTQEDRLVLLKGVNGAFRPGVLTALMGVSGAGKTTLMDVLAGRKTGGYIDGNITISGYPKNQQTFARISGYCEQTDIHSPHVTVYESLVYSAWLRLPKEVDKNKRKIFIEEVMELVELTPLRQALVGLPGESGLSTEQRKRLTIAVELVANPSIIFMDEPTSGLDARAAAIVMRTVRNTVDTGRTVVCTIHQPSIDIFEAFDELFLLKRGGEEIYVGPLGHESTHLINYFESIQGINKITEGYNPATWMLEVSTTSQEAALGVDFAQVYKNSELYKRNKELIKELSQPAPGSKDLYFPTQYSQSFLTQCMASLWKQHWSYWRNPPYTAVRFLFTIGIALMFGTMFWDLGGKTKTRQDLSNAMGSMYTAVLFLGLQNAASVQPVVNVERTVFYREQAAGMYSAMPYAFAQVFIEIPYVLVQAIVYGLIVYAMIGFEWTAVKFFWYLFFMYGSFLTFTFYGMMAVAMTPNHHIASVVSSAFYGIWNLFSGFLIPRPSMPVWWEWYYWLCPVAWTLYGLIASQFGDITEPMADSNMSVKQFIREFYGYREGFLGVVAAMNVIFPLLFAVIFAIGIKSFNFQKR

SEQ ID NO: 118 - DNA, 1125 bp, Arabidopsis thaliana
atggcgttatccaaagatttgatgttgaaatgctcggaagacatgatgagtgcttacaaatctgcttgtgaagaacacccaaaactaaaatcctttgatgcttcccttcagcagcgaaccaacaaaatgatagactcactcaccgttgaagacaagaatggttcgtcctccccacacgacgcacacatggagctctccaagcacctagttgaagttacccaaggtgtggcagacttcattaccgaaatcgaagacgatgtgtgggacaaccaagctctaaagtatttggtcctggcctattttgaaaatactaaaaagactttagagattttcaaaactatagagaactgcgtcgagaacgcagaaatgggccaacttctcattcgagaggccttggccgagtttgagaaagagtcggcagaaaaagatgttggtgggaaaaagaagaagtatgaaaaaacattggaggacctcaagagttttaaagagatgggagatccctttgacggcaaagttctcacaactcagttcgagcggatcaaaaagcagcaagaatcccttctggaggaagtgagtgagactagaaaaaagattcaggacgaaattagtaatctagagaaaaaaactttaattacgaacgtggttttcggcgctgcgtttgctattgttgcggttgcatccatagctctaattgcaacaggcgtgggtgcggctgccggctttggggctctagccgcaccactgcttgcggcaggatgggctggagtctacactaccttggataaaaagaaggatgctctgaacaaacagttagaaggtctaaagaaagtggaagagatagaagaatcggtggagaaaggtataaaaaccaacgaagaagcgacggagaccgtatcgattttagtcgacgggctagaagaccgtatcaaaaatatgttgaaacttgtagataatgctattgaccatgaagataatgaggcggccacgagaattgtcctaactcagatcagtaagaaagtagagaaattaacaaagaaaatcacggaggttggtgaaagtgtggaagatcatagcaagttgattgcaaaggccagacttcaagttctgcaaaagatcaaccgttaa

SEQ ID NO: 119 - protein, 374 aa, Arabidopsis thaliana
MALSKDLMLKCSEDMMSAYKSACEEHPKLKSFDASLQQRTNKMIDSLTVEDKNGSSSPHDAHMELSKHLVEVTQGVADFITEIEDDVWDNQALKYLVLAYFENTKKTLEIFKTIENCVENAEMGQLLIREALAEFEKESAEKDVGGKKKKYEKTLEDLKSFKEMGDPFDGKVLTTQFERIKKQQESLLEEVSETRKKIQDEISNLEKKTLITNVVFGAAFAIVAVASIALIATGVGAAAGFGALAAPLLAAGWAGVYTTLDKKKDALNKQLEGLKKVEEIEESVEKGIKTNEEATETVSILVDGLEDRIKNMLKLVDNAIDHEDNEAATRIVLTQISKKVEKLTKKITEVGESVEDHSKLIAKARLQVLQKINR

SEQ ID NO: 120 - DNA, 621 bp, Arabidopsis thaliana
atgtcatccatagagccaaaagtaatgatggttggtgctaataagaaacaacgaaccgtccaagctagttcgaggaaaggttgtatgagaggaaaaggtggacccgataacgcgtcttgcacttacaaaggtgttagacaacgcacttggggcaaatgggtcgctgagatccgcgagcctaaccgaggagctcgtctttggctcggtaccttcgacacctcccgtgaagctgccttggcttatgactccgcagctcgtaagctctatgggcctgaggctcatctcaacctccctgagtccttaagaagttaccctaaaacggcgtcgtctccggcgtcccagactacaccaagcagcaacaccggtggaaaaagcagcagcgactctgagtcgccgtgttcatccaacgagatgtcatcatgtggaagagtgacagaggagatatcatgggagcatataaacgtggatttgccggtaatggatgattcttcaatatgggaagaagctacaatgtcgttaggatttccatgggttcatgaaggagataatgatatttctcggtttgatacttgtatttccggtggctattctaattgggattcctttcattccccactttga

SEQ ID NO: 121 - protein, 206 aa, Arabidopsis thaliana
MSSIEPKVMMVGANKKQRTVQASSRKGCMRGKGGPDNASCTYKGVRQRTWGKWVAEIREPNRGARLWLGTFDTSREAALAYDSAARKLYGPEAHLNLPESLRSYPKTASSPASQTTPSSNTGGKSSSDSESPCSSNEMSSCGRVTEEISWEHINVDLPVMDDSSIWEEATMSLGFPWVHEGDNDISRFDTCISGGYSNWDSFHSPL

SEQ ID NO: 122 - DNA, 807 bp, Arabidopsis thaliana
atggaagtaacttcccaatctaccctccctccagggttcagatttcatcctaccgacgaagaactcatcgtttactatcttcgaaaccagaccatgtctaaaccatgccctgtctccatcatcccagaagttgatatctacaaattcgacccatggcaattacccgagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcaagtaacgtaggtgtcaagaaagctctagtcttctacaaaggtagacctcctaaaggaatcaaaactgactggatcatgcatgagtatcgtctccatgattcacgtaaagcatcaacgaaacgtaacggttccatgaggttagatgaatgggtactgtgtaggatatacaagaagagaggagcaagtaagcttctgaatgagcaagagggtttcatggacgaagtactaatggaggatgagacaaaagttgtagttaacgaagcagagagaagaactgaagaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggaccttcagtttaaccaagacgagatcttaaaccatcatcgtcaagcgatgtttaagttttag

SEQ ID NO: 123 - protein, 268 aa, Arabidopsis thaliana
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRNGSMRLDEWVLCRIYKKRGASKLLNEQEGFMDEVLMEDETKVVVNEAERRTEEEIMMMTSMKLPRTCSLAHLLEMDYMGPVSHIDNFSQFDHLHQPDSESSWFGDLQFNQDEILNHHRQAMFKF

SEQ ID NO: 124 - DNA, 1200 bp, Arabidopsis thaliana
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 125 - protein, 399 aa, Arabidopsis thaliana
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 126 - DNA, 462 bp, Arabidopsis thaliana
atgaggcggctaccaccgtggatgctcggtggcgcgtcaaccggtgaagcagctgcacgcaatggttcacaacccgaagctcccaaaacaaaggctgaaaaacgaccaaaaagagtccaaaaaaccaaagagaaagacttaaatctcaagtcagatgaacctaaacgagttcccaggaagattagggaagaagctaagcgtagcccggaggtgattcaatcagtgactgttcctgaagatgatgatctcacagttgatgacttattaagctttgctaatgagtatgtccaacgtgatgaggaaggaacaagaaaggagcgtgaaagaagcttgtcagtgtctgaaactacgctagttctcgatgaaaccaatatgactacatcatctcaaggaggaaccaaagattcaacagcagaagacatgttacaattgctaatgggtcctttttacaagaaacgttag

SEQ ID NO: 127 - protein, 153 aa, Arabidopsis thaliana
MRRLPPWMLGGASTGEAAARNGSQPEAPKTKAEKRPKRVQKTKEKDLNLKSDEPKRVPRKIREEAKRSPEVIQSVTVPEDDDLTVDDLLSFANEYVQRDEEGTRKERERSLSVSETTLVLDETNMTTSSQGGTKDSTAEDMLQLLMGPFYKKR

SEQ ID NO: 128 - DNA, 366 bp, Arabidopsis thaliana
atgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctga

SEQ ID NO: 129 - protein, 121 aa, Arabidopsis thaliana
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 130 - DNA, 897 bp, Arabidopsis thaliana
atgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 131 - protein, 298 aa, Arabidopsis thaliana
MLETKDPAIKLFGMKIPFPTVLEVADEEEEKNQNKTLTDQSEKDKTLKKPTKILPCPRCNSMETKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 132 - DNA, 270 bp, Arabidopsis thaliana
atggcttttttgaggagtttcttgggtgctaagcaaattattcgaagggaatcatcgtcgacaccaagaggattcatggcggtctatgtaggagagaatgatcagaagaagaagagatatgtggtgccggtttcatacttaaaccagcctttgtttcaacaactgttgagtaaatctgaggaagagtttggttatgatcatccaatgggcggcttaacaataccatgtcatgaatctttgttcttcacagtcacatctcagatacaatga

SEQ ID NO: 133 - protein, 89 aa, Arabidopsis thaliana
MAFLRSFLGAKQIIRRESSSTPRGFMAVYVGENDQKKKRYVVPVSYLNQPLFQQLLSKSEEEFGYDHPMGGLTIPCHESLFFTVTSQIQ

SEQ ID NO: 134 - DNA, 843 bp, Arabidopsis thaliana
atgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtcatagcaaaggaatcaacggggatgatgaccagggtataaagaattcagagaataacaacggtgatgatgttcatcatgaagatggtgatcatgaggatgatgatgatcataatgctacaccaccattgacatttattgagaaatggcttttggaggaaacaagtactactgggggtcaaatggaagagatgagccacttgatggagctctctaatatgctttaa

SEQ ID NO: 135 - protein, 280 aa, Arabidopsis thaliana
MGRPPCCDKIGIKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKLNKSDSDERSRSENIALQTSSTRNTINHRSTYASSTENISRLLEGWMRASPKSSTSTTFLEHKMQNRTNNFIDHHSDQFPYEQLQGSWEEGHSKGINGDDDQGIKNSENNNGDDVHHEDGDHEDDDDHNATPPLTFIEKWLLEETSTTGGQMEEMSHLMELSNML

SEQ ID NO: 136 - DNA, 3090 bp, Arabidopsis thaliana
atggcgatccctcgacttttcttcctcttctattacattggtttcgctcttttcccttttgtttcttctgaaacatttcaaaactccgaacaagagatcttgttggccttcaagtcagacctttttgatccttcaaataatctccaagattggaagagacctgagaatgccacaacattttctgagttggttcattgtcattggacaggagttcactgtgatgcaaatggctatgtggctaagcttcttctctccaacatgaatctcagcggaaacgtgtcagatcagattcagagcttcccttctctgcaagcccttgatctcagcaataacgcatttgagtcttctcttcctaaatctctttctaatctcacgtctttgaaggtcattgatgtgagtgtgaacagcttctttggaaccttcccttatggtctaggaatggcaactggtcttacacacgtcaatgcctcaagcaacaatttttcggggtttctacctgaagatcttggcaacgcaactacacttgaggttttggactttcgaggaggttacttcgagggctcagtgccttcttctttcaagaatctcaagaatctgaagtttctcggtctttcgggtaacaactttggtggaaaggtaccgaaggtgattggtgagctctcttccttggagaccattattcttggttacaatggcttcatgggtgagattccagaagagtttgggaaattgacgcgccttcagtaccttgatttggctgttggaaaccttacaggccagattccatcttctttggggcagctgaaacaacttacaacagtttatctctaccagaaccgtctcacagggaaacttcctcgagaacttggtggtatgacttctcttgtgtttcttgatctgtctgataaccagatcacaggagaaatacctatggaagtaggtgagttgaagaatctgcagcttctaaatttgatgaggaatcaactcacgggaatcattccgtcaaaaattgctgaattaccaaaccttgaggttcttgagctgtggcagaactctctcatgggttcattaccggtgcatctcggcaaaaattccccattgaagtggttagacgtctcatcaaacaagctttcaggagatataccatcaggattgtgctattccagaaacctcacaaagctcattctcttcaacaactcattctcaggtcagattccggaggaaatcttctcatgtccgactttagttcgtgttcgaatccagaaaaatcacatttccggatctataccagctggttcaggtgacttaccaatgcttcagcatctagagctcgcaaaaaacaacctcaccggtaaaattccagatgatatagccttatccacatcactctcatttatagacatatcatttaatcatctctcatccctatcttcctccattttctcaagtcctaatcttcaaaccttcattgcctcacataacaactttgccggaaaaattcctaaccagattcaagatcgtccatctttgtctgtcctcgatctttccttcaaccatttctcaggtggaatcccagaaaggatcgcttcttttgaaaaacttgtgagtctaaatctcaagagcaaccaattggttggagaaatccctaaggcattagccgggatgcacatgttagctgttcttgatctctcaaacaactctttgacggggaatataccagcggacttgggagcttctccaacactggagatgttaaacgtgtcattcaacaaactcgacggacccattccttcaaacatgctgtttgcagccatagacccaaaagacctcgtgggaaacaatggcttatgcggtggagttctaccaccttgctctaagagcctagctttgtcagcaaaaggccgaaatccagggagaattcacgtgaatcacgcagtcttcgggttcattgttggaacttcagtcatcgtggctatggggatgatgttcttggcagggagatggatatacacaagatgggatctttacagcaactttgctagagagtatatattctgcaagaaacctcgggaggaatggccatggagactcgtggctttccagagactgtgcttcactgcaggagacatcttatcacatatcaaagaatcaaacatcattggaatgggagccatagggattgtttacaaagcagaagtcatgagacggccattactcactgtagctgtgaaaaaactgtggagatcaccatcaccacaaaatgatatcgaagatcatcatcaagaagaagatgaagaggacgacatactcagagaagtgaacctacttggtggtctacgacatagaaacattgtgaagattctaggttacgttcacaacgagagagaagtgatgatggtatacgagtacatgcccaatggaaacctaggaactgctttgcattccaaagatgagaaattcttactaagagattggctctcacgatacaatgtcgccgtcggagtcgttcaaggtctcaattacttgcacaacgattgctatcctccgatcattcacagagacatcaagtctaataacatcctcctcgattcaaaccttgaagcgaggatagcagatttcggattggcgaagatgatgcttcataagaacgagaccgtttctatggtggctggatcttacgggtatatagcgccggagtacggatacacactgaagattgacgaaaagagtgatatatacagtctaggcgttgtgcttctggaattggtgactgggaaaatgccgatagatccttcgtttgaggattcgattgacgtggttgagtggattcggaggaaggtgaagaagaacgagagcttggaagaagtgatcgacgcgagcatcgccggagattgtaaacacgtgatcgaagagatgctcctggcactgcgaatcgctcttctctgcaccgcgaagctaccgaaggatagaccatcgattagagacgtcatcacaatgctcgcggaggcgaagccacgccggaaaagtgtttgccaagtcgccggggatttgccgattttcagaaactcgccagtggtagggctgatttag

SEQ ID NO: 137 - protein, 1029 aa, Arabidopsis thaliana [sequence omitted]

SEQ ID NO: 138 - DNA, 1233 bp, Arabidopsis thaliana
atgagatcaagcagccaaaattctgaaaactccaagacttgtctatctaacaacatcaaagcaaccaccaagaatgaagaagataaagatgaagaggatgatgaagaaggcgaagaggatgaagaagagagatctggagatcagagcccatctagcaatagctatgaggaagagagtgggagtcaccaccatgatcagaacaagaagaatggaggatccgtgaggccgtacaaccgctcaaagactccgaggctgcgatggacgccggagctccatatttgctttcttcaagctgtggagagattgggtggcccagatagagcaacaccgaagcttgttctccaattgatgaacgtcaaggggctaagtattgcccatgttaagagtcatcttcagatgtacagaagcaagaagaccgatgagcctaatgaaggagatcaaggattttcgtttgaacacggagctggttacacttacaaccttagccaacttccaatgctacaaagttttgatcaaaggccttcttctagtttaggatatggtggtggttcgtggactgaccacagacgacagatctaccgtagcccttggagaggattaacgacacgagaaaatacaagaacaagacaaacaatgtttagctcacagcctggtgagagatatcacggagttagcaatagtattcttaacgataagaacaaaactatttcatttcgaatcaattctcatgaaggggttcatgataacaatggagtagctggagctgttccaagaattcatagaagttttcttgaaggtatgaaaacgtttaacaaatcatggggacagagcctctcttccaatcttaagtcctccaccgcaacaataccacaagatcatattgctacaacgctaaattcttatcaatgggagaatgctggagtggcagaaggatcagagaatgttttgaagaggaagaggttattattttctgatgactgcaataagtcagaccaagatttggatctaagcttgtcccttaaggtacctcggacacacgacaatcttggagaatgcttgttagaagatgaagtaaaagaacatgatgatcatcaagatatcaagagtttgtctctttcgttatcatcttcaggttcatcaaaactcgaccgaaccattaggaaagaagatcaaactgatcacaaaaagagaaagatttcggtcttggcaagtccccttgatctcactctgtga

SEQ ID NO: 139 - protein, 410 aa, Arabidopsis thaliana
MRSSSQNSENSKTCLSNNIKATTKNEEDKDEEDDEEGEEDEEERSGDQSPSSNSYEEESGSHHHDQNKKNGGSVRPYNRSKTPRLRWTPELHICFLQAVERLGGPDRATPKLVLQLMNVKGLSIAHVKSHLQMYRSKKTDEPNEGDQGFSFEHGAGYTYNLSQLPMLQSFDQRPSSSLGYGGGSWTDHRRQIYRSPWRGLTTRENTRTRQTMFSSQPGERYHGVSNSILNDKNKTISFRINSHEGVHDNNGVAGAVPRIHRSFLEGMKTFNKSWGQSLSSNLKSSTATIPQDHIATTLNSYQWENAGVAEGSENVLKRKRLLFSDDCNKSDQDLDLSLSLKVPRTHDNLGECLLEDEVKEHDDHQDIKSLSLSLSSSGSSKLDRTIRKEDQTDHKKRKISVLASPLDLTL

SEQ ID NO: 140 - DNA, 972 bp, Arabidopsis thaliana
atgaatccaaatctccttgagaaagatctaagaggtaaggaaactacaaatgggtcaataagatacaaagaagcaaacaacttcagatctctaccaaactcacacactgctgcttgtaaaacttcactcaacaacccctctatctctagaaaccatcctcacaacaaatcagcctcagtcttggagtcggaagatgaacatgggaacgagagaggtgaaaacgaaaagagtttaagaatgaggggcaaaagtggaattaacacaaaagtatgctcacgaggacactggagaccaacagaagatgctaaactcaaggagcttgttgcccagtttggtccccaaaactggaacttgatttctaaccaccttcttggtagatcaggcaagagttgtagattgagatggtttaaccaactagacccaaggattaacaagagagccttcacggaggaagaagagtttaggctgttagcagctcatcgagcctatggcaacaagtgggctttgatctctcgtctctttccaggtcgtaccgataacgctgtcaagaaccattggcacgtcatcatggctcgacggactagagaaagccaaagacaacgtcaacagcctcctccgacgttgtcaagagacgctgaaatgacggtttcgtcctcttgccgctacaatcaaggtaagttcatcaatgaagaagatgacgacgacgatgtgtcagctgtctctacttgtacgacggagctctctctcactccgccttcttcagcttaccagcctcgcttctttaattacgatagtacccttgcatcaggcaaagatggtcagtgtgtgcagagagcagaagtaaatggcatatatggtaaaaagatggaccatcaaaatcaccacacaatctcagtcagtgaaagaaaggtggagatgaagatgaggagtggctattactactttgattttcttggagttggagcttcctga

SEQ ID NO: 141 - protein, 323 aa, Arabidopsis thaliana
MNPNLLEKDLRGKETTNGSIRYKEANNFRSLPNSHTAACKTSLNNPSISRNHPHNKSASVLESEDEHGNERGENEKSLRMRGKSGINTKVCSRGHWRPTEDAKLKELVAQFGPQNWNLISNHLLGRSGKSCRLRWFNQLDPRINKRAFTEEEEFRLLAAHRAYGNKWALISRLFPGRTDNAVKNHWHVIMARRTRESQRQRQQPPPTLSRDAEMTVSSSCRYNQGKFINEEDDDDDVSAVSTCTTELSLTPPSSAYQPRFFNYDSTLASGKDGQCVQRAEVNGIYGKKMDHQNHHTISVSERKVEMKMRSGYYYFDFLGVGAS

SEQ ID NO: 142 - DNA, 1119 bp, Arabidopsis thaliana
atgctctgttttgttcgctttcaggctggttttgtgagaattatagttgcagcaagaaagcgtttcagatattttttaatggccgctgaggatcgaagtgaggaactaagcagcaatgtagaaaatggaagttgcaattccaatgaaggaattaatcctgaaaccagcagtcattggattgaaaacgttgtcaaggttaggaaaccgtacacagtaactaagcagagagagaagtggagtgaggaagagcatgataggtttcttgaagctatcaagctttatggtcgtggttggcgtcaaatccaagaacacataggtacaaaaaccgctgtacagatacgaagccatgctcaaaagttcttctccaagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctag

SEQ ID NO: 143 - protein, 372 aa, Arabidopsis thaliana
MLCFVRFQAGFVRIIVAARKRFRYFLMAAEDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 144 - DNA, 549 bp, Arabidopsis thaliana
atgtctttctccgtgaaaggtcgaagcttacgtggcaacaataacggaggaacggggacgaagtgcgggagatggaatccaacggtggagcagttgaagatattgactgatctgtttcgagccggtcttagaactccaacaactgatcagattcagaagatctctacggagctcagtttctacggcaagatagagagcaagaatgttttctattggtttcagaatcataaggctagggagaggcagaaacgtcgtaaaatctccattgattttgatcatcatcatcatcaaccatcaactagagatgtttttgaaataagcgaagaagattgtcaagaggaagagaaggtgatagagacattacaactctttccggtgaattcatttgaagactccaactccaaggtggacaaaatgagagctagaggcaataaccagtaccgtgaatatattcgagagaccaccacgacgtcgttttctccatactcatcatgtggagctgaaatggaacatccaccgccattagatcttcgattaagctttctttaa

SEQ ID NO: 145 - protein, 182 aa, Arabidopsis thaliana
MSFSVKGRSLRGNNNGGTGTKCGRWNPTVEQLKILTDLFRAGLRTPTTDQIQKISTELSFYGKIESKNVFYWFQNHKARERQKRRKISIDFDHHHHQPSTRDVFEISEEDCQEEEKVIETLQLFPVNSFEDSNSKVDKMRARGNNQYREYIRETTTTSFSPYSSCGAEMEHPPPLDLRLSFL

SEQ ID NO: 146 - DNA, 1059 bp, Arabidopsis thaliana
atgtggaaccttaacgactcacccgatcatcacgaagaatccgacagtagagggaatccggtcggacacgtgtcaaacgggatgagtcaatctgcaacgtggctaccgtttgtgcttccggtgaccaggaatttctttccggctcaaagcatggaaccgggagttcgttggtccggtttcaatagtgtcggtaagtcggatccaagcggatcgggtcgaccagaagagccggagatatcaccgccgataaagaagagccgacgtggtcctcgctcacgtagctctcagtatcgaggagttacgttttaccgacgaaccggaagatgggagtcacatatttgggactgtgggaagcaagtgtacttaggtggatttgacactgcacatgctgctgctcgagcctatgatcgagcggcgattaaattcagaggtgtagatgcagatattaatttcgacattgaagactaccttgacgatttgaaacagatgggaaatttgacaaaggaagagtttatgcatgtacttagaaggcaaagcactgggtttccaagaggcagttctaaatacagaggtgttactttgcacaaatgtggaagatgggagtcacgtttgggtcaattcctcaacaaaaagtacgtttatttgggtctctttgataccgagattgaagctgctagagcttatgataaagcggcaataaagtgtaatgggaaagacgctgttaccaattttgaccctaaagtatacgaggaagaagaagatcttagctcagagacgacgaggaacggtcataatcttggtctaagtctaggagaatcatcatctgaagagtttagactcaagtctgatattgcaagcataagaagtaggattagagatgaggagagattattagggagcgatctatcgctagcaatgatgacgacgactgtcagatcggaaaagcagcaatcggacggtggaggaaatcgagtggtgggaatggcagcatcatcaggattctctcctcaaccttccccttaccgcattcctcgcaccttccacttctctcgtccctga

SEQ ID NO: 147 - protein, 352 aa, Arabidopsis thaliana
MWNLNDSPDHHEESDSRGNPVGHVSNGMSQSATWLPFVLPVTRNFFPAQSMEPGVRWSGFNSVGKSDPSGSGRPEEPEISPPIKKSRRGPRSRSSQYRGVTFYRRTGRWESHIWDCGKQVYLGGFDTAHAAARAYDRAAIKFRGVDADINFDIEDYLDDLKQMGNLTKEEFMHVLRRQSTGFPRGSSKYRGVTLHKCGRWESRLGQFLNKKYVYLGLFDTEIEAARAYDKAAIKCNGKDAVTNFDPKVYEEEEDLSSETTRNGHNLGLSLGESSSEEFRLKSDIASIRSRIRDEERLLGSDLSLAMMTTTVRSEKQQSDGGGNRVVGMAASSGFSPQPSPYRIPRTFHFSRP

SEQ ID NO: 148 - DNA, 588 bp, Arabidopsis thaliana
atggatacacaaaggttgccgaagaaagaagaagaagaagaagaagatcatctactttcttcaaccttcgagtccatcaatggtcactctcgagaccaacacaatcattctatagatgatttcgagagcattttcgacatcaccattgacaatttaagctgctctaacgaactcacgtgggatttctgggaagaagacgaagatgaagatgtaggggaagaagaaaaaagatcgagtactgatcaagaaggctcaagttttgggttttgggagaataagccgacggattatgaagacaaagacttgggtctgaagctgaatctgaaccatcaagaagttatcgatgcttggtctgatcaccagaaacctctgtggacagatacttcaactctggacaattccgtttataggggagaagtgccagtgatagaggagaagagaaacatgcgaagagaagcaagtgtgttaaggtacaaagagaaaagacagagtaggctcttctctaagaagataaggtaccaagtccgaaaactcaacgcagataaacgacctcgttttaagggtcggttcgtgaaaagagagacttaa

SEQ ID NO: 149 - protein, 195 aa, Arabidopsis thaliana
MDTQRLPKKEEEEEEDHLLSSTFESINGHSRDQHNHSIDDFESIFDITIDNLSCSNELTWDFWEEDEDEDVGEEEKRSSTDQEGSSFGFWENKPTDYEDKDLGLKLNLNHQEVIDAWSDHQKPLWTDTSTLDNSVYRGEVPVIEEKRNMRREASVLRYKEKRQSRLFSKKIRYQVRKLNADKRPRFKGRFVKRET

SEQ ID NO: 150 - DNA, 768 bp, Arabidopsis thaliana
atgggaaggggtagggttgaattgaagaggatagagaacaagatcaatagacaagtgacattctcgaaaagaagaactggtcttttgaagaaagctcaggagatctctgttctttgtgatgccgaggtttcccttattgtcttctcccataagggcaaattgttcgagtactcctctgaatcttgcatggagaaggtactagaacgctacgagaggtattcttacgccgagagacagctgattgcacctgactctcacgttaatgcacagacgaactggtcaatggagtatagcaggcttaaggccaagattgagcttttggagagaaaccaaaggcattatctgggagaagagttggaaccaatgagcctcaaggatctccaaaatctggagcagcagcttgagactgctcttaagcacattcgctccagaaaaaatcaactcatgaatgagtccctcaaccacctccaaagaaaggagaaggagatacaggaggaaaacagcatgcttaccaaacagataaaggagagggaaaacatcctaaggacaaaacaaacccaatgtgagcagctgaaccgcagcgtcgacgatgtaccacagccacaaccatttcaacacccccatctttacatgatcgctcatcagacttctcctttcctaaatatgggtggtttgtaccaagaagaagaccaaacggcgatgaggaggaacaatctggatctgactcttgaacccatttacaattaccttggctgttacgccgcttga

SEQ ID NO: 151 - protein, 255 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNAQTNWSMEYSRLKAKIELLERNQRHYLGEELEPMSLKDLQNLEQQLETALKHIRSRKNQLMNESLNHLQRKEKEIQEENSMLTKQIKERENILRTKQTQCEQLNRSVDDVPQPQPFQHPHLYMIAHQTSPFLNMGGLYQEEDQTAMRRNNLDLTLEPIYNYLGCYAA

SEQ ID NO: 152 - DNA, 1161 bp, Arabidopsis thaliana
atgttaactgtttctccggctccagtactcatcggaaacaactcaaaggatacttacatggcggcagatttcgcagattttacgacggaagacttgccggactttacgacggtcggggatttttccgatgatcttcttgatggaatcgattactacgacgatcttttcattggtttcgatggagacgatgttttgccggatttggagatagattcggagattcttggggaatattccggtagcggaagagatgaggaacaagaaatggagggtaacacttcgacggcatcggagacatcggagagagacgttggtgtgtgtaagcaagagggtggtggtggtggtgacggtggttttagggacaaaacggtgcgtcgaggcaaacgtaaagggaagaaaagtaaagattgtttatccgatgagaacgatattaagaaaaaacctaaggtggattggacgccggagttacaccggaaatttgtacaagcggtggagcaattaggggtagacaaggcggtgccgtctcgaatcttggaaattatgaacgttaaatctctcactcgtcacaacgttgctagccatcttcagaaatataggtcacatcggaaacatctactagcgcgtgaagcagaagctgccagctggaatctccggagacatgccacggtggcagtgcccggagtaggaggaggagggaagaagccgtggacagctcctgccttaggctatcctccacacgtggcaccaatgcatcatggtcacttcaggcctttgcacgtatggggtcatcctacgtggccaaaacacaagcctaatactccggcgtctgctcatcggacgtatccaatgccggccattgcggcggctccggcatcttggccaggtcatccaccgtactggcatcagcaaccactctatccacagggatatggtatggcatcatcgaatcattcaagcatcggtgttcccacaagacaattaggacccactaatcctcccatcgacattcatccctcgaatgagagcatagatgcagctattggggacgttatatcaaagccgtggctgccgcttcctttgggactgaaaccgccgtcggttgacggtgttatgacggagttacaacgtcaaggagtttctaatgttcctcctcttccttga

SEQ ID NO: 153 - protein, 386 aa, Arabidopsis thaliana
MLTVSPAPVLIGNNSKDTYMAADFADFTTEDLPDFTTVGDFSDDLLDGIDYYDDLFIGFDGDDVLPDLEIDSEILGEYSGSGRDEEQEMEGNTSTASETSERDVGVCKQEGGGGGDGGFRDKTVRRGKRKGKKSKDCLSDENDIKKKPKVDWTPELHRKFVQAVEQLGVDKAVPSRILEIMNVKSLTRHNVASHLQKYRSHRKHLLAREAEAASWNLRRHATVAVPGVGGGGKKPWTAPALGYPPHVAPMHHGHFRPLHVWGHPTWPKHKPNTPASAHRTYPMPAIAAAPASWPGHPPYWHQQPLYPQGYGMASSNHSSIGVPTRQLGPTNPPIDIHPSNESIDAAIGDVISKPWLPLPLGLKPPSVDGVMTELQRQGVSNVPPLP

SEQ ID NO: 154 - DNA, 621 bp, Arabidopsis thaliana
atggcggttggtgaggtcatgaggatggagattcccgccggtggagatttgactgttactactccggagttgcatgttcttgccgtcgatgatagtattgtggatcgtaaagtcatcgagaggttgcttagaatctcttcttgtaaagtgacgactgtagagagtggaactagggctttgcagtatcttggcttagatggaggcaaaggggcttctaatcttaaggatttgaaggtgaatttgatagtgacggattactcaatgccaggactttcaggatatgatctccttaaaaagattaaggaatcttcagcattcagagaagtaccagtagtgattatgtcatctgagaacatcttacctcgtatacaagaatgtctcaaagaaggagcagaggaattcttgttgaaaccggtgaagctagcagatgtaaagcgaatcaaacaacttataatgaggaatgaagctgaggaatgcaaaatcttaagccattctaacaagagaaagcttcaagaagacagtgatacatcatcatcaagtcatgatgatacttctatcaaggactcttcatgttcaaaacgaatgaaatcagaatctgaaaaccttttttctctactttga

SEQ ID NO: 155 - protein, 206 aa, Arabidopsis thaliana
MAVGEVMRMEIPAGGDLTVTTPELHVLAVDDSIVDRKVIERLLRISSCKVTTVESGTRALQYLGLDGGKGASNLKDLKVNLIVTDYSMPGLSGYDLLKKIKESSAFREVPVVIMSSENILPRIQECLKEGAEEFLLKPVKLADVKRIKQLIMRNEAEECKILSHSNKRKLQEDSDTSSSSHDDTSIKDSSCSKRMKSESENLFSLL

SEQ ID NO: 156 - DNA, 1053 bp, Arabidopsis thaliana
atgtggacgatgggttacaacgaaggaggcgcagattccttcaacggaggaagaaagcttcgtcctctcatcccacgtctcacttcttgccccaccgccgccgtaaacaccaactccgaccaccgctttaatatggcagtggtgacgatgacggcggagcagaacaagagggagctgatgatgctaaactcagaacctcaacatccaccggtaatggtgagctcacggtggaatccgacaccagatcagttaagggttcttgaagagctttaccgacaaggaactagaactccttctgccgaccacatccaacaaatcaccgcacagctacgacggtacgggaagatagaaggcaaaaacgttttctattggttccaaaaccacaaagcccgagaacgccagaaacgacggcgacaaatggaaactggccacgaagaaacggtcctttcaacagcaagtcttgtctcaaaccacggattcgacaagaaagatcctccaggttacaaggttgaacaggtcaagaactggatatgttcggtcggatgcgacacgcaaccagagaaaccttcccgtgattatcatctggaggagccagcgaatatacgggtggagcacaatgctcgttgtggaggagacgagagacgaagctttttagggataaacaccacgtggcagatgatgcagttgccacctagtttctactcttcttcacatcatcatcatcaacgtaacctcattctcaattcacctactgtttcctccaacatgtccaacagcaacaatgctgtctctgcttctaaagatacggtcacggtttcacctgtatttctacgtacgagagaagcaacgaacacagagacttgtcatcgaaatggtgatgataataaagatcaagaacaacatgaagattgctccaacggtgaattggatcatcaagaacagacacttgagctgtttccactgagaaaagaagggttttgtagcgatggtgagaaagacaagaacattagtggcattcactgtttctatgagtttctgccattgaagaactaa

SEQ ID NO: 157 - protein, 350 aa, Arabidopsis thaliana
MWTMGYNEGGADSFNGGRKLRPLIPRLTSCPTAAVNTNSDHRFNMAVVTMTAEQNKRELMMLNSEPQHPPVMVSSRWNPTPDQLRVLEELYRQGTRTPSADHIQQITAQLRRYGKIEGKNVFYWFQNHKARERQKRRRQMETGHEETVLSTASLVSNHGFDKKDPPGYKVEQVKNWICSVGCDTQPEKPSRDYHLEEPANIRVEHNARCGGDERRSFLGINTTWQMMQLPPSFYSSSHHHHQRNLILNSPTVSSNMSNSNNAVSASKDTVTVSPVFLRTREATNTETCHRNGDDNKDQEQHEDCSNGELDHQEQTLELFPLRKEGFCSDGEKDKNISGIHCFYEFLPLKN

SEQ ID NO: 158 - DNA, 864 bp, Arabidopsis thaliana
atggtgactgtaaaccctagccaagctcattgtttgcctatgaaaatgagtctaccgggtttcaatactcttccccacacggcaacaacgataccggtttccatacggagcaataggacgatgtcgttttttgaggatccaacaaagaaggttagaaagccttacactatcaccaaatctagagagaactggacggagcaagaacacgacaagttccttgaagcccttcatctatttgaccgggattggaagaaaataaaggcctttgttggatcaaaaacagtgatacagatacgaagccacgcacagaagtactttctcaaagttcagaagaatgggactaaagaacatctcccacctcctcgaccaaagaggaaagccaatcacccatatccacaaaaagctcctaaatttactctttcttcttcaaacgcattatttcaacatgactacttatacaacactaattcacatccggtgattagcaccacccgtaagcatggattagtgcattgcgatgttagtataccaagttctgttatcaaagaggaatttggtgtctcagagaactgttgcagcactagtagtagtagagataagcagaggactagaatcgttacagagacaaatgaccaagaaagttgtggaaagccacatagagtggcgccaaatttcgctgaagtttacaattttataggaagtgtgtttgatcctaaaacaacaggtcatgtcaagagattaaaggaaatggatccaataaatcttgagacggttctcttactgatgaaaaatttatctgtaaacctgacgagtcccgagtttgatgaacaacggaagttgatatcatcttacaacgccagttag

SEQ ID NO: 159 - protein, 287 aa, Arabidopsis thaliana
MVTVNPSQAHCLPMKMSLPGFNTLPHTATTIPVSIRSNRTMSFFEDPTKKVRKPYTITKSRENWTEQEHDKFLEALHLFDRDWKKIKAFVGSKTVIQIRSHAQKYFLKVQKNGTKEHLPPPRPKRKANHPYPQKAPKFTLSSSNALFQHDYLYNTNSHPVISTTRKHGLVHCDVSIPSSVIKEEFGVSENCCSTSSSRDKQRTRIVTETNDQESCGKPHRVAPNFAEVYNFIGSVFDPKTTGHVKRLKEMDPINLETVLLLMKNLSVNLTSPEFDEQRKLISSYNAS

SEQ ID NO: 160 - DNA, 1836 bp, Arabidopsis thaliana
atggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttga

SEQ ID NO: 161 - protein, 611 aa, Arabidopsis thaliana
MARDQFYGHNNHHHQEQQHQMINQIQGFDETNQNPTDHHHYNHQIFGSNSNMGMMIDFSKQQQIRMTSGSDHHHHHHQTSGGTDQNQLLEDSSSAMRLCNVNNDFPSEVNDERPPQRPSQGLSLSLSSSNPTSISLQSFELRPQQQQQQGYSGNKSTQHQNLQHTQMMMMMMNSHHQNNNNNNHQHHNHHQFQIGSSKYLSPAQELLSEFCSLGVKESDEEVMMMKHKKKQKGKQQEEWDTSHHSNNDQHDQSATTSSKKHVPPLHSLEFMELQKRKAKLLSMLEELKRRYGHYREQMRVAAAAFEAAVGLGGAEIYTALASRAMSRHFRCLKDGLVGQIQATSQALGEREEDNRAVSIAARGETPRLRLLDQALRQQKSYRQMTLVDAHPWRPQRGLPERAVTTLRAWLFEHFLHPYPSDVDKHILARQTGLSRSQVSNWFINARVRLWKPMIEEMYCEETRSEQMEITNPMMIDTKPDPDQLIRVEPESLSSIVTNPTSKSGHNSTHGTMSLGSTFDFSLYGNQAVTYAGEGGPRGDVSLTLGLQRNDGNGGVSLALSPVTAQGGQLFYGRDHIEEGPVQYSASMLDDDQVQNLPYRNLMGAQLLHDIV

SEQ ID NO: 162 - DNA, 1176 bp, Arabidopsis thaliana
atggcaccagataacgaccatttcttagattctccgtcgccgcctcttctagagatgagacaccaccaatcagcgacggagaacggtggtggttgcggcgagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaa

SEQ ID NO: 163 - protein, 391 aa, Arabidopsis thaliana
MAPDNDHFLDSPSPPLLEMRHHQSATENGGGCGEIVEVQGGHIVRSTGRKDRHSKVCTAKGPRDRRVRLSAPTAIQFYDVQDRLGFDRPSKAVDWLITKAKSAIDDLAQLPPWNPADTLRQHAAAAANAKPRKTKTLISPPPPQPEETEHHRIGEEEDNESSFLPASMDSDSIADTIKSFFPVASTQQSYHHQPPSRGNTQNQDLLRLSLQSFQNGPPFPNQTEPALFSGQSNNQLAFDSSTASWEQSHQSPEFGKIQRLVSWNNVGAAESAGSTGGFVFASPSSLHPVYSQSQLLSQRGPLQSINTPMIRAWFDPHHHHHHHQQSMTTDDLHHHHPYHIPPGIHQSAIPGIAFASSGEFSGFRIPARFQGEQEEHGGDNKPSSASSDSRH

SEQ ID NO: 164 - DNA, 1299 bp, Arabidopsis thaliana
atgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgaatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatttgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttga

SEQ ID NO: 165 - protein, 432 aa, Arabidopsis thaliana
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 166 - DNA, 2163 bp, Arabidopsis thaliana
atgataaagattgcagatttcactctcttcttctttatcttcgtcttctctccctcgttgcctctagctcaatctcagcttcccgatctcgacccacaagacaaagcttctttattgatattcagagtttcgattcacgacctaaatcgaagcttatcgacatggtacggctcatcgtgttctaactggacaggtctagcttgtcagaatccgaccggaaaagttctctccctcactttatccggtctgaatctctccagtcagattcacccatctctttgtaagctctcttctcttcaaagcttggacctttctcacaacaacttctctggaaacattccttcttgcttcggttcgttgcgtaatcttaggacacttaatcttagtcggaatagattcgttggttcgatacccgccacatttgtaagtcttaaggagcttagagaagttgttctaagtgagaatagagatttaggcggtgtggtccctcattggtttggtaatttctcaatgaatcttgagagagttgattttagtttctgctcgtttgttggagaactacctgagagtttactgtatttgaagtctctcaagtacttgaatcttgagagcaataacatgactggtacactcagagattttcagcagccattggtggttcttaatcttgcttcaaatcagttttccggtacgctaccttgtttctacgcctctcgtccgtctcttagtattctgaatatagctgagaactctctggttggtggattaccttcttgtttgggttctttaaaagagctgagtcatttgaatctatctttcaatggcttcaactacgagatatctcctaggcttatgttttcagagaagcttgtgatgttggacttgagtcacaacgggttttcaggtcgtcttcctagtagaatctcggaaacaactgagaaattgggtttggttcttcttgacctctctcacaatagcttttctggtgatataccgttgaggatcacagagttgaagagtttacaagcattgcgtctctctcacaatcttttaactggagatattcctgctagaattggtaatctgacatatctccaggtcattgatctttcccacaacgcgttaaccggctcaatacctctcaacattgttggttgctttcagttacttgctctgatgataagtaacaacaatctctctggcgaaatacaacccgagcttgatgcgttggatagtctaaagatactggacataagcaacaaccatatatccggtgagatcccgcttactttagctggtctgaagtctctagagattgtggatataagttccaacaacctctcggggaaccttaatgaagccattaccaaatggtccaacctcaagtatctttctcttgcccggaacaagtttagtggaacacttccttcttggttgttcaagtttgacaaaatccaaatgattgactactccagcaacagattctcttggttcataccagacgataacttaaacagcacacgcttcaaagattttcagaccggtggaggtgaaggatttgctgagccaccaggaaaagtagagatcaaaatatcagcagctgttgttgctaaagatgaattaagtttcagctacaatctattgtctatggttgggatcgatctttctgacaatctattacatggagagatcccagaagctttgttcagacagaagaatattgagtacttgaacttgtcctacaacttccttgaaggtcagcttccacgtctagagaagctgccaaggttaaaggccttagatctttcacacaactctctgtcaggtcaagtcattggaaacatctcagctcctccaggactaaccctactgaacctatcgcacaactgtttctctggtatcattaccgagaaagaagggctcgggaagtttccaggggcgttggccggaaatccggaactgtgtgtggaaactcccggaagcaagtgtgacccggcaaacattgatgcatcacaagaggaaatatatcaaaacgaattggtggaaggaccgatatctatttggatattctgcttaagtgcgtttattagcttcgattttggagtgttaggtatcttttgctcagctcgtgctcgtagttatattcttcagaccaaagcttaa

SEQ ID NO: 167 - protein, 720 aa, Arabidopsis thaliana
MIKIADFTLFFFIFVFSPSLPLAQSQLPDLDPQDKASLLIFRVSIHDLNRSLSTWYGSSCSNWTGLACQNPTGKVLSLTLSGLNLSSQIHPSLCKLSSLQSLDLSHNNFSGNIPSCFGSLRNLRTLNLSRNRFVGSIPATFVSLKELREVVLSENRDLGGVVPHWFGNFSMNLERVDFSFCSFVGELPESLLYLKSLKYLNLESNNMTGTLRDFQQPLVVLNLASNQFSGTLPCFYASRPSLSILNIAENSLVGGLPSCLGSLKELSHLNLSFNGFNYEISPRLMFSEKLVMLDLSHNGFSGRLPSRISETTEKLGLVLLDLSHNSFSGDIPLRITELKSLQALRLSHNLLTGDIPARIGNLTYLQVIDLSHNALTGSIPLNIVGCFQLLALMISNNNLSGEIQPELDALDSLKILDISNNHISGEIPLTLAGLKSLEIVDISSNNLSGNLNEAITKWSNLKYLSLARNKFSGTLPSWLFKFDKIQMIDYSSNRFSWFIPDDNLNSTRFKDFQTGGGEGFAEPPGKVEIKISAAVVAKDELSFSYNLLSMVGIDLSDNLLHGEIPEALFRQKNIEYLNLSYNFLEGQLPRLEKLPRLKALDLSHNSLSGQVIGNISAPPGLTLLNLSHNCFSGIITEKEGLGKFPGALAGNPELCVETPGSKCDPANIDASQEEIYQNELVEGPISIWIFCLSAFISFDFGVLGIFCSARARSYILQTKA

SEQ ID NO: 168 - DNA, 1806 bp, Arabidopsis thaliana
atgaagaagatcttcatcacactcttatggcttctcttcataagctcgtttctctgttcttcttcttcagctgaagacgacgttctctgtctccaaggtttgaaaaactcactcatcgatccttcttctagactcagttcctggtctttcccaaactcttcagcttcttcgatttgtaagctcactggtgtttcctgctggaacgagaaagagaatcggattatttctcttcagcttcaatcgatgcagctcgccggtgagattcctgagtctcttaagctttgtcgtagtttacaatctctggatctctctggaaacgatctctctggttcgattccttctcaaatctgttcgtggcttccttatctcgttacgttagatctgtctgggaataagcttggtggttcgattccgactcagatcgttgagtgtaagttcttaaacgctttgattctgagtgataataagctttctggttcgattccttctcagttgagtcgattagatcgccttcgacgtctttctctagcagggaatgatctctccggtacgattccgtccgagctggctcggttcggaggagacgattttagcgggaataacggactttgtgggaagcctttatcgcgatgtggagcgttgaatgggagaaatctgagtattattatagttgctggagttcttggagctgttggatctttgtgcgttggtttagttatattctggtggttctttattagagaaggtagtaggaagaagaaaggttatggtgctgggaagtctaaggatgatagtgattggattggtttgttgaggtcacataagcttgttcaggtgactttgtttcagaaacctattgtgaagattaaattgggtgatttaatggctgctacgaacaattttagttcagggaatatcgatgtttcgtcgaggactggggtttcgtataaagcggatttacctgatgggtctgcacttgcggtgaagaggcttagtgcttgtgggtttggtgagaaacagtttaggtcggagatgaataagttaggagagcttagacatccgaatttggtgccgcttttagggtattgtgttgtggaagatgagagactgttggtgtataagcatatggttaatggtacgttgttttctcagttgcacaatggtggattgtgtgatgctgttttggattggccgactcggcgtgcgattggtgtgggagctgctaaagggttagcttggttgcatcatggatgccaaccgccgtatttgcatcagtttattagctccaatgttatacttcttgatgatgattttgatgctcggataacagattacggattggcaaagctagttggatctcgtgattcgaacgatagctcgttcaataatggggatttgggggagttaggttatgtagcgcctgagtattcgagcaccatggttgcgtctttgaaaggagatgtgtatgggtttgggattgtgcttcttgaattggttacagggcaaaagcctttgtctgttattaacggtgtggaagggtttaaagggagtttagttgactgggtgagtcagtatttgggtactggtagaagcaaagacgctattgatagaagcatatgtgataaaggacacgatgaggagatattgcagttcctgaaaatcgcatgtagctgtgttgtgtccaggcctaaggaaaggccaacgatgattcaggtgtatgaatctttgaagaacatggcagataaacacggtgtttcggagcattacgatgaatttcctctggtcttcaacaaacaagaagcttga

SEQ ID NO: 169 - protein, 601 aa, Arabidopsis thaliana
MKKIFITLLWLLFISSFLCSSSSAEDDVLCLQGLKNSLIDPSSRLSSWSFPNSSASSICKLTGVSCWNEKENRIISLQLQSMQLAGEIPESLKLCRSLQSLDLSGNDLSGSIPSQICSWLPYLVTLDLSGNKLGGSIPTQIVECKFLNALILSDNKLSGSIPSQLSRLDRLRRLSLAGNDLSGTIPSELARFGGDDFSGNNGLCGKPLSRCGALNGRNLSIIIVAGVLGAVGSLCVGLVIFWWFFIREGSRKKKGYGAGKSKDDSDWIGLLRSHKLVQVTLFQKPIVKIKLGDLMAATNNFSSGNIDVSSRTGVSYKADLPDGSALAVKRLSACGFGEKQFRSEMNKLGELRHPNLVPLLGYCVVEDERLLVYKHMVNGTLFSQLHNGGLCDAVLDWPTRRAIGVGAAKGLAWLHHGCQPPYLHQFISSNVILLDDDFDARITDYGLAKLVGSRDSNDSSFNNGDLGELGYVAPEYSSTMVASLKGDVYGFGIVLLELVTGQKPLSVINGVEGFKGSLVDWVSQYLGTGRSKDAIDRSICDKGHDEEILQFLKIACSCVVSRPKERPTMIQVYESLKNMADKHGVSEHYDEFPLVFNKQEA

SEQ ID NO: 170 - DNA, 1668 bp, Arabidopsis thaliana
atgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaagacatagatggactggtagatatgaagctcatctatgggacaatagtttcaagaaggaaggtcacagtagaaaaggaagacaagtttatctgggaggttatgatatggaggagaaagctgctcgagcatatgatcttgctgcactcaagtactggggtccctctactcacaccaatttctctgcggagaattatcagaaagagattgaagacatgaagaacatgactagacaagaatatgttgcacatttgagaaggaagagcagtggtttctctaggggtgcttccatctatagaggagtcacaagacatcaccagcatggaaggtggcaagcacggattggtagagtcgctggaaacaaagatctctaccttggaacttttggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttga

SEQ ID NO: 171 - protein, 555 aa, Arabidopsis thaliana
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 172 - DNA, 1458 bp, Arabidopsis thaliana
atgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatag

SEQ ID NO: 173 - protein, 485 aa, Arabidopsis thaliana
MLDLNLDVDSTESTQNERDSITVKGVSLNQMDESVTSNSSVVNAEASSCIDGEDELCSTRTVKFQFEILKGGGEEEEEDDDERSAVMMTKEFFPVAKGMNFMDSSAQSSRSTVDISFQRGKQGGDFIGSGSGGGDASRVMQPPSQPVKKSRRGPRSKSSQYRGVTFYRRTGRWESHIWDCGKQVYLGGFDTAHAAARAYDRAAVKFRGLEADINFVIGDYEEDLKQMANLSKEEVVQVLRRQSSGFSRNNSRYQGVALQKIGGWGAQMEQLHGNMGCDKAAVQWKGREAASLIEPHASRMIPEAANVKLDLNLGISLSLGDGPKQKDRALRLHHVPNNSVCGRNTMMENHMAAAACDTPFNFLKRGSDHLNNRHALPSAFFSPMERTPEKGLMLRSHQSFPARTWQGHDQSSGGTAVAATAPPLFSNAASSGFSLSATRPPSSTAIHHPSQPFVNLNQPGLYVIHPSDYISQHQHNLMNRPQPPP

SEQ ID NO: 174 - DNA, 600 bp, Arabidopsis thaliana
atggcatcttcttcaacaaactcaccatgcgccgcttgcaaattcctccggcgaaaatgtcaaccggaatgtgtattcgcgccctatttcccaccggaccagccacaaaaattcgcaaacgttcacaaagtgtttggagcaagtaacgtgacaaagctcctcaacgagcttcacccttcacaacgtgaagacgcagtgaactctttggcctatgaagccgacatgcgcctccgtgaccctgtctacggctgcgtcggcgtcatctctctcctccaacatcagcttcgtcagcttcagatagatctcagctgtgctaaatctgagctctctaagtaccaaagcctcggtatcctcgccgccactcatcagagtcttggcatcaacttactcgccggagcagcagatggaacagccaccgccgtgagagaccactatcaccaccaccagttttttcctagagaacaaatgtttggtggcttggatgttccggccggtaacaactacgacggtgggattcttgccattggacagatcactcagtttcagcagccgagagccgccgctggagatgatggtcgccgtactgttgatccgtcttga

SEQ ID NO: 175 - protein, 199 aa, Arabidopsis thaliana
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHHHQFFPREQMFGGLDVPAGNNYDGGILAIGQITQFQQPRAAAGDDGRRTVDPS

SEQ ID NO: 176 - DNA, 612 bp, Arabidopsis thaliana
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtttaaagagatgtggaaagagttgtagattgaggtggatgaattatctcagccctaatgtgaaaagaggcaatttcaccgagcaagaagaggatcttatcattaggctccacaagttgcttggtaataggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 177 - protein, 203 aa, Arabidopsis thaliana
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 178 - DNA, 756 bp, Arabidopsis thaliana
atgaaggttcatgagttttcgaatgggttttcttcatcgtgggatcaacatgactcgacatcatcccttagcctaagctgcaaacgcctccgtcctctcgcccctaagctctccggcagccctccctcccctccttcttcttcctccggcgtcacttcagccacttttgaccttaaaaacttcattagacccgatcaaaccggtccgacaaaatttgaacacaaacgagaccctcctcatcaattggagacgcacccgggagggacaaggtggaacccgactcaagaacagatagggatacttgagatgttgtacaaaggtggaatgcgtactcctaatgctcaacagattgagcatatcacattgcaactcggtaagtacgggaaaatcgaagggaaaaatgtgttctattggttccagaaccacaaagcccgcgagagacagaagcagaagaggaacaacctcatcagcctaagttgccaaagcagcttcacgaccactggtgtctttaatccgagtgtaactatgaagacaagaacatcatcgtcactagacattatgagagaaccaatggtggagaaggaggagttagtggaagagaatgagtacaagaggacatgtaggagctggggatttgagaacttggagatagagaacaggagaaacaaaaatagtagtactatggcaactacttttaataaaatcattgacaatgtaaccctcgagctttttcctctccatcctgaagggagatga

SEQ ID NO: 179 - protein, 251 aa, Arabidopsis thaliana
MKVHEFSNGFSSSWDQHDSTSSLSLSCKRLRPLAPKLSGSPPSPPSSSSGVTSATFDLKNFIRPDQTGPTKFEHKRDPPHQLETHPGGTRWNPTQEQIGILEMLYKGGMRTPNAQQIEHITLQLGKYGKIEGKNVFYWFQNHKARERQKQKRNNLISLSCQSSFTTTGVFNPSVTMKTRTSSSLDIMREPMVEKEELVEENEYKRTCRSWGFENLEIENRRNKNSSTMATTFNKIIDNVTLELFPLHPEGR

SEQ ID NO: 180 - DNA, 876 bp, Arabidopsis thaliana
atgcaagaagcggcactaggtatgatgggagccaccgtaggcggagacggagacaccgcggtcgtggcggagcagaatagacagttgaaaggtgagatagcgacacatccgatgtatgagcaattattagccgcacacgtggcgtgtttaagagtagctactccaatagatcaacttccgatcattgaagctcagctttctcaatctcatcatcttctccgttcttacgcttccacggccgttggataccatcatgatcgtcacgagctcgataatttcttggcacaatatgtaatggtgttgtgtagcttcaaagaacagctgcaacagcacgtgagggttcatgccgtcgaagctgttatggcttgccgtgaaattgagaacaaccttcattctcttacaggagcaactttaggagaagggtcgggtgcgactatgtcggaggatgaggatgatcttccgatggatttctcgtcagataattccggcgttgattttagcggcggccacgatatgacgggatttggtccgttgctaccgactgaatcggaaagatcccttatggaaagagtcagacaagaactcaaactagaactcaaacagggttttaaatcgagaatcgaagatgtaagagaagagataatgaggaagagaagggctgggaaattgccaggagacacaactactgtcttgaaaaattggtggcaacaacattgcaaatggccttaccctacggaagatgacaaggcaaaattggtggaggagacaggattgcagttgaagcaaatcaacaattggttcattaaccaacgcaagaggaattggcacaacaactctcactccctcacttccttgaagtccaagcgcaaacactaa

SEQ ID NO: 181 - protein, 291 aa, Arabidopsis thaliana
MQEAALGMMGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 182 - DNA, 1263 bp, Arabidopsis thaliana
atggatcctgaaggtttcacgagtggcttattccggtggaacccaacgagagcattggttcaagcaccacctccggttccacctccgctgcagcaacagccggtgacaccgcagacggctgcttttgggatgcgacttggtggtttagagggactattcggtccgtacggtatacgtttctacacggcggcgaagatagcggagttaggttttacggcgagcacgcttgtgggtatgaaggacgaggagcttgaagagatgatgaatagtctctctcatatctttcgttgggagcttcttgttggtgaacggtacggtatcaaagctgccgttagagctgaacggagacgattgcaagaagaggaggaagaggaatcttctagacgccgtcatttgctactctccgccgctggtgattccggtactcatcacgctcttgatgctctctcccaagaagggttatctgaggaaccggtgcagcaacaagaccagactgatgcggcggggaataacggcggaggaggaagtggttactgggacgcaggtcaaggaaagatgaagaagcaacagcagcagagacggagaaagaaaccaatgctgacgtcagtggaaaccgacgaagacgtcaacgaaggtgaggatgacgacgggatggataacggcaacggaggtagtggtttggggacagagagacagagggagcatccgtttatcgtaacggagcctggggaagtggcacgtggcaaaaagaacggcttagattatctgttccacttgtacgaacaatgccgtgagttccttcttcaggtccagacaattgctaaagaccgtggcgaaaaatgccccaccaaggtgacgaaccaagtattcaggtacgcgaagaaatcaggagcgagttacataaacaagcctaaaatgcgacactacgttcactgttacgctctccactgcctagacgaagaagcttcaaatgctctcagaagagcgtttaaagaacgcggtgagaacgttggctcatggcgtcaggcttgttacaagccacttgtgaacatcgcttgtcgtcatggctgggatatagacgccgtctttaacgctcatcctcgtctctctatttggtatgttccaacaaagctgcgtcagctttgccatttggagcggaacaatgcggttgctgcggctgcggctttagttggcggtattagctgtaccggatcgtcgacgtctggacgtggtggatgcggcggcgacgacttgcgtttctag

SEQ ID NO: 183 - protein, 420 aa, Arabidopsis thaliana
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 184 - DNA, 990 bp, Arabidopsis thaliana
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaagaaacaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatga

SEQ ID NO: 185 - protein, 329 aa, Arabidopsis thaliana
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKKQVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 186 - DNA, 1197 bp, Arabidopsis thaliana
atggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaagattggagctccacctgatgtggttgatagaattacggcggcacggcaagactttgaggctcgacaacagcggtcaacaccgtctgtctctgcctcctctagagacccggagttagatcaattcatggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctgatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataa

SEQ ID NO: 187 - protein, 398 aa, Arabidopsis thaliana
MEEYQHDNSTTPQRVSFLYSPISSSNKNDNTSDTNNNNNNNNSSNYGPGYNNTNNNNHHHQHMLFPHMSSLLPQTTENCFRSDHDQPNNNNNPSVKSEASSSRINHYSMLMRAIHNTQEANNNNNDNVSDVEAMKAKIIAHPHYSTLLQAYLDCQKIGAPPDVVDRITAARQDFEARQQRSTPSVSASSRDPELDQFMEAYCDMLVKYREELTRPIQEAMEFIRRIESQLSMLCQSPIHILNNPDGKSDNMGSSDEEQENNSGGETELPEIDPRAEDRELKNHLLKKYSGYLSSLKQELSKKKKKGKLPKEARQKLLTWWELHYKWPYPSESEKVALAESTGLDQKQINNWFINQRKRHWKPSEDMQFMVMDGLQHPHHAALYMDGHYMGDGPYRLGP

SEQ ID NO: 188 - DNA, 1041 bp, Arabidopsis thaliana
atgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccatag

SEQ ID NO: 189 - protein, 346 aa, Arabidopsis thaliana
MLDLNLKIFSSYNEDQDRKVPLMISTTGEEESNSSSSSTTDSAARDAFIAFGILKRDDDLVPPPPPPPHKETGDLFPVVADARRNIEFSVEDSHWLNLSSLQRNTQKMVKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNGHNDLELSLGISSSSESIKLTTGDYYKGINRSTMGLYGKQSSIFLPMATMKPLKTVAASSGFPFISMTSSSSSMSNCFDP

SEQ ID NO: 190 - DNA, 933 bp, Arabidopsis thaliana
atggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatatctctggctgaagaaacaggtttggatcaaaaacaaatcaacaattggtttataaaccaaaggaaacgccattggaagccttcggagaacatgccgtttgatatgatggacgattctaatgaaacattctttaccgagtaa

SEQ ID NO: 191 - protein, 310 aa, Arabidopsis thaliana
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKISLAEETGLDQKQINNWFINQRKRHWKPSENMPFDMMDDSNETFFTE

SEQ ID NO: 192 - DNA, 1149 bp, Arabidopsis thaliana
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggttggagcaccaccggaggttgtggcgaggctagaggaggcatgctcgtctgccgcagccgctgccgcatctatgggaccaacaggatgtctaggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttga

SEQ ID NO: 193 - protein, 382 aa, Arabidopsis thaliana
MESGSNSTSCPMAFAGDNSDGPMCPMMMMMPPIMTSHQHHGHDHQHQQQEHDGYAYQSHHQQSSSLFLQSLAPPQGTKNKVASSSSPSSCAPAYSLMEIHHNEIVAGGINPCSSSSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 194 - DNA, 1164 bp, Arabidopsis thaliana
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 195 - protein, 387 aa, Arabidopsis thaliana
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 196 - DNA, 1290 bp, Arabidopsis thaliana
atgtcaggagctaccaccgcttcctccggagaccacaacaacctccgtctcccaactccgacgcttgacgccgaatcgcaaactctgctgcaatcgatttctgctgaagggggttacgcttatgctcgcatggcggtgttagcggtggccggtgaccaaagcgcggcggaggcggcgcgtgatatggcttgggagcaacttcactctggtccgtggcactcggttctccccgtttggcgcgacgcttactcaatggcttgtctccacgtagctaaaatccatttcgccgccggcgagtttggtgaggcgcttggtgcgcttgatatgggtcttatcatgggaggtatgcttctccgcaaggatcttcatgattctgttttgttggtctcctctgaagctcgtaagatgacgaagagtcttgaagaagcttctggagatttcaaaggtgagagattggtcccggaagttcccgtcgacgtcaatgaggtgagacatgttttggctaatctacaattacttgtccttaagattctaccttgcaggtctttaacttgtaaaagagtagagaagaggtctggtttatctttggaggggtttctgcgtgattattatctgccaggtacaccagttgttataaccaattctatggctcattggccagccaggaccaagtggaatcacttggactacctcaatgctgttgctggtaaccgcaccgttcccgtggaggtggggaaaaactatttgtgttctgattggaagcaagagcttgtgacattttctaagttccttgaacggatgcggaccaataaatcgtctccaatggagcctacttatcttgcccagcatcctttgtttgatcagataaatgaactgagagatgatatatgtattcctgattactgttttgtcggtggtggggaactccaatcacttaatgcatggtttggcccggctgggacagttactccgttacaccatgatccacatcataatatacttgctcaggttgttggcaagaagtatataaggctttacccatccttcctgcaagacgaactttacccttactctgagacaatgctctgcaactctagtcaggttgatctagacaatatcgacgaaaccgagttcccaaaggccatggagttggagtttatggattgtattctagaagaaggtgaaatgttgtacatccctcccaaatggtggcactatgtcaggtccttaacaatgagtctctcggttagcttctggtggagcaatgaagcagaatcttctagctcgtag

SEQ ID NO: 197 - protein, 429 aa, Arabidopsis thaliana
MSGATTASSGDHNNLRLPTPTLDAESQTLLQSISAEGGYAYARMAVLAVAGDQSAAEAARDMAWEQLHSGPWHSVLPVWRDAYSMACLHVAKIHFAAGEFGEALGALDMGLIMGGMLLRKDLHDSVLLVSSEARKMTKSLEEASGDFKGERLVPEVPVDVNEVRHVLANLQLLVLKILPCRSLTCKRVEKRSGLSLEGFLRDYYLPGTPVVITNSMAHWPARTKWNHLDYLNAVAGNRTVPVEVGKNYLCSDWKQELVTFSKFLERMRTNKSSPMEPTYLAQHPLFDQINELRDDICIPDYCFVGGGELQSLNAWFGPAGTVTPLHHDPHHNILAQVVGKKYIRLYPSFLQDELYPYSETMLCNSSQVDLDNIDETEFPKAMELEFMDCILEEGEMLYIPPKWWHYVRSLTMSLSVSFWWSNEAESSSS

SEQ ID NO: 198 - DNA, 975 bp, Arabidopsis thaliana
atgactatgcgatcatctttaccttcttcctcttccgcttattcactcgcttcaacaagtttgagcaacagacttgagaccatcttcaagaaagcttcagagctttgcactctctgtgatattgaagcctgcgtcatctattacggaccagacggagaactcaagacatggcctccggagcgagagaaagtgagagacattgctcttaggtatagtcaattaaacgaagcattgagacgcaagaaaagcgttaatcttcatgggttcctgaacaagaagaagaagaacaagggtttgaagaatacggacaagaagaggaagacgagtcttaagaaggtgaatgttttaaagtatccactcgctgatcattaccctcccgaccaagtttctccactgattcagtccttggaactccatgtctctaaattccacgaaaggcttgaatttcttgagtcgcggaaacagaatgagacacaaccggatcaccacagtttagcatcatcctctctgaatcatcagacccaatctttgaaccctagccagttctcgctgtttatgtataatcatggagacaatactctgtctcagatcccagtctctgcatcaaatttcaatcaggattatttctcagcgttacttgaacaatctgagttgaagaatcagttaatgaagcaggagatttgtggtaatgatcagaatcagaacatgtggatgggtaacatcaccaacaacaattttcaacttccttgcgtctcagtacaagaatctgtgaacaactttgggttgatgcacaaggagttttatggttgtgatcataacatgtctgtgggtaacatcaatagcaacagctgtgaacatccttgcgtctcaagcacacaacattactcggcggtagaagaatctgtgaataacccctggttgaatcagttgatgcagaatgaactttatggttacggttatgcagacttttgttaa

SEQ ID NO: 199 - protein, 324 aa, Arabidopsis thaliana
MTMRSSLPSSSSAYSLASTSLSNRLETIFKKASELCTLCDIEACVIYYGPDGELKTWPPEREKVRDIALRYSQLNEALRRKKSVNLHGFLNKKKKNKGLKNTDKKRKTSLKKVNVLKYPLADHYPPDQVSPLIQSLELHVSKFHERLEFLESRKQNETQPDHHSLASSSLNHQTQSLNPSQFSLFMYNHGDNTLSQIPVSASNFNQDYFSALLEQSELKNQLMKQEICGNDQNQNMWMGNITNNNFQLPCVSVQESVNNFGLMHKEFYGCDHNMSVGNINSNSCEHPCVSSTQHYSAVEESVNNPWLNQLMQNELYGYGYADFC

SEQ ID NO: 200 - DNA, 1053 bp, Arabidopsis thaliana
atgaaaactctacacaggacttggatagtggatggcccatggatctcaaggaatgtaaagaatgcgtctctgtcttcagctctgcagattaaagactgcggagcttatatcaactgctttaactgctcttaccgcatcgacaacagcaatgtactgactccatggccaggccttcctaaaggtgtgaaattcgagccaaccgatgaggaagtgattgagcatttggaagctaagtgtggtattgatggcttaaaaccacatcttcttatccaagactttatatgttcagtcactcaagatgttggtatcaactacactcaccctcaaaaccttccaggtgtgagtaaagatggaactagtgtcttcttctttaacaagacggcacatgcatatcaaaatgggcagagaaagcggagaaggatcacaccaactagtctcaaggatgatacggttcgctggcacaagactggtcaaaccaaaccggtgatgctcaatggaatccagaagggatgcaagaagatcatggtgctctacaagagcgcgagaaagggattcaaacccgagaaatctaactgggttttgcaccagtaccatttgggaactgaagaaggcgagattggggaatatgttgtctctaagatcacatatcagcaaccaaagcaacaggagaaaaccatcgatgagagtgagagttctggggttcgaggtggccctagcacaccgaaaactagtactattacacaagttagacctgtgatttctgttgatgaggatgaaatagcttttgatgatgattctaagatggttcttgattcatatgccgagggactggagaacattcaagaagcttcttctggttcgacatcagacaaaatagctaaagtgggagggaatgtgagtgttattgaagataacttaatgtccaagaaaattgaagcttcgtcgattcctaatcatggaaatgttgactacggatcaggaaacttttcagtttcagatttggagaatgcagaattagggactctccctgatttactttccgtgagaacataa

SEQ ID NO: 201 - protein, 350 aa, Arabidopsis thaliana
MKTLHRTWIVDGPWISRNVKNASLSSALQIKDCGAYINCFNCSYRIDNSNVLTPWPGLPKGVKFEPTDEEVIEHLEAKCGIDGLKPHLLIQDFICSVTQDVGINYTHPQNLPGVSKDGTSVFFFNKTAHAYQNGQRKRRRITPTSLKDDTVRWHKTGQTKPVMLNGIQKGCKKIMVLYKSARKGFKPEKSNWVLHQYHLGTEEGEIGEYVVSKITYQQPKQQEKTIDESESSGVRGGPSTPKTSTITQVRPVISVDEDEIAFDDDSKMVLDSYAEGLENIQEASSGSTSDKIAKVGGNVSVIEDNLMSKKIEASSIPNHGNVDYGSGNFSVSDLENAELGTLPDLLSVRT

SEQ ID NO: 202 - DNA, 858 bp, Arabidopsis thaliana
atgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctctag

SEQ ID NO: 203 - protein, 285 aa, Arabidopsis thaliana
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMDFWFDVLARTGGEQDLLAGL

SEQ ID NO: 204 - DNA, 1182 bp, Arabidopsis thaliana
atggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgcctctgccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggggtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttga

SEQ ID NO: 205 - protein, 393 aa, Arabidopsis thaliana
MAFHNNHFNHFTDQQQHQPPPPPQQQQQQHFQESAPPNWLLRSDNNFLNLHTAASAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 206 - DNA, 2943 bp, Arabidopsis thaliana
atggcgatgagacttttgaagactcatcttctgtttctgcatctgtatctatttttctcaccatgtttcgcttacactgacatggaagttcttctcaatctcaaatcctccatgattggtcctaaaggacacggtctccacgactggattcactcatcttctccggatgctcactgttctttctccggcgtctcatgtgacgacgatgctcgtgttatctctctcaacgtctccttcactcctttgtttggtacaatctcaccagagattgggatgttgactcatttggtgaatctaactttagctgccaacaacttcaccggtgaattaccattggagatgaagagtctaacttctctcaaggttttgaatatctccaacaatggtaaccttactggaacattccctggagagattttaaaagctatggttgatcttgaagttcttgacacttataacaacaatttcaacggtaagttaccaccggagatgtcagagcttaagaagcttaaatacctctctttcggtggaaatttcttcagcggagagattccagagagttatggagatattcaaagcttagagtatcttggtctcaacggagctggactctccggtaaatctccggcgtttctttcccgcctcaagaacttaagagaaatgtatattggctactacaacagctacaccggtggtgttccaccggagttcggtggtttaacaaagcttgagatcctcgacatggcgagctgtacactcaccggagagattccgacgagtttaagtaacctgaaacatctacatactctgtttcttcacatcaacaacttaaccggtcatataccaccggagctttccggtttagtcagcttgaaatctctcgatttatcaatcaatcagttaaccggagaaatccctcaaagcttcatcaatctcggaaacattactctaatcaatctcttcagaaacaatctctacggacaaataccagaggccatcggagaattaccaaaactcgaagtcttcgaagtatgggagaacaatttcacgttacaattaccggcgaatcttggccggaacgggaatctaataaagcttgatgtctctgataatcatctcaccggacttatccccaaggacttatgcagaggtgagaaattagagatgttaattctctctaacaacttcttctttggtccaattccagaagagcttggtaaatgcaaatccttaaccaaaatcagaatcgttaagaatcttctcaacggcactgttccggcggggcttttcaatctaccgttagttacgattatcgaactcactgataatttcttctccggtgaacttccggtaacgatgtccggcgatgttctcgatcagatttacctctctaacaactggttttccggcgagattccacctgcgattggtaatttccccaatctacagactctattcttagatcggaaccgatttcgcggcaacattccgagagaaatcttcgaattgaagcatttatcgaggatcaacacaagtgcgaacaacatcaccggcggtattccagattcaatctctcgctgctcaactttaatctccgtcgatctcagccgtaaccgaatcaacggagaaatccctaaagggatcaacaacgtgaaaaacttaggaactctaaatatctccggtaatcaattaaccggttcaatccctaccggaatcggaaacatgacgagtttaacaactctcgatctctctttcaacgatctctccggtagagtaccactcggtggtcaattcttggtgttcaacgaaacttccttcgccggaaacacttacctctgtctccctcaccgtgtctcttgtccaacacggccaggacaaacctccgatcacaatcacacggcgttgttctcaccgtcaaggatcgtaatcacggttatcgcagcgatcaccggtttgatcctaatcagtgtagcgattcgtcagatgaataagaagaagaaccagaaatctctcgcctggaaactaaccgccttccagaaactagatttcaaatctgaagacgttctcgagtgtcttaaagaagagaacataatcggtaaaggcggagctggaattgtctaccgtggatcaatgccaaacaacgtagacgtcgcgattaaacgactcgttggccgtgggaccgggaggagcgatcatggattcacggcggagattcaaactttggggagaatccgccaccgtcacatagtgagacttcttggttacgtagcgaacaaggatacgaatctccttctttatgagtacatgcctaatggaagccttggagagcttttgcatggatctaaaggtggtcatcttcaatgggagacgagacatagagtagccgtggaagctgcaaagggcttgtgttatcttcaccatgattgttcaccattgatcttgcatagagatgttaagtccaataacattcttttggactctgattttgaagcccatgttgctgattttgggcttgctaagttcttagttgatggtgctgcttctgagtgtatgtcttcaattgctggctcttatggatacatcgccccagagtatgcatataccttgaaagtggacgagaagagtgatgtgtatagtttcggagtggttttgttggagttaatagctgggaagaaacctgttggtgaatttggagaaggagtggatatagttaggtgggtgaggaacacggaagaggagataactcagccatcggatgctgctattgttgttgcgattgttgacccgaggttgactggttacccgttgacaagtgtgattcatgtgttcaagatcgcaatgatgtgtgtggaggaagaagccgcggcaaggcctacgatgagggaagttgtgcacatgctcactaaccctcctaaatccgtggcgaacttgatcgcgttctga

SEQ ID NO: 207 - protein, 980 aa, Arabidopsis thaliana
MAMRLLKTHLLFLHLYLFFSPCFAYTDMEVLLNLKSSMIGPKGHGLHDWIHSSSPDAHCSFSGVSCDDDARVISLNVSFTPLFGTISPEIGMLTHLVNLTLAANNFTGELPLEMKSLTSLKVLNISNNGNLTGTFPGEILKAMVDLEVLDTYNNNFNGKLPPEMSELKKLKYLSFGGNFFSGEIPESYGDIQSLEYLGLNGAGLSGKSPAFLSRLKNLREMYIGYYNSYTGGVPPEFGGLTKLEILDMASCTLTGEIPTSLSNLKHLHTLFLHINNLTGHIPPELSGLVSLKSLDLSINQLTGEIPQSFINLGNITLINLFRNNLYGQIPEAIGELPKLEVFEVWENNFTLQLPANLGRNGNLIKLDVSDNHLTGLIPKDLCRGEKLEMLILSNNFFFGPIPEELGKCKSLTKIRIVKNLLNGTVPAGLFNLPLVTIIELTDNFFSGELPVTMSGDVLDQIYLSNNWFSGEIPPAIGNFPNLQTLFLDRNRFRGNIPREIFELKHLSRINTSANNITGGIPDSISRCSTLISVDLSRNRINGEIPKGINNVKNLGTLNISGNQLTGSIPTGIGNMTSLTTLDLSFNDLSGRVPLGGQFLVFNETSFAGNTYLCLPHRVSCPTRPGQTSDHNHTALFSPSRIVITVIAAITGLILISVAIRQMNKKKNQKSLAWKLTAFQKLDFKSEDVLECLKEENIIGKGGAGIVYRGSMPNNVDVAIKRLVGRGTGRSDHGFTAEIQTLGRIRHRHIVRLLGYVANKDTNLLLYEYMPNGSLGELLHGSKGGHLQWETRHRVAVEAAKGLCYLHHDCSPLILHRDVKSNNILLDSDFEAHVADFGLAKFLVDGAASECMSSIAGSYGYIAPEYAYTLKVDEKSDVYSFGVVLLELIAGKKPVGEFGEGVDIVRWVRNTEEEITQPSDAAIVVAIVDPRLTGYPLTSVIHVFKIAMMCVEEEAAARPTMREVVHMLTNPPKSVANLIAF

SEQ ID NO: 208 - DNA, 495 bp, Arabidopsis thaliana
atgggagctgggagagaagtcagcgtatcgctagatggagtcagagacaaaaacttgatgcagcttaagatactcaacacggttttgttcccggttcgttacaacgacaagtactacgccgatgcaatcgctgccggcgaattcaccaagcttgcatattacaatgacatatgtgttggagctatcgcctgtcggctggagaagaaagaaagtggggccatgcgagtttatataatgacgcttggtgttcttgcaccctaccgtgggattggcattggctcaaatctattgaatcatgttcttgacatgtgctccaagcaaaacatgtgtgagatatacttgcatgtgcagacaaacaacgaagacgcaatcaagttctacaagaagttcggctttgagatcacagataccatacaaaactattacatcaacattgagccaagagattgctacgttgtcagcaagtcctttgctcaatctgaagccaacaaatga

SEQ ID NO: 209 - protein, 164 aa, Arabidopsis thaliana
MGAGREVSVSLDGVRDKNLMQLKILNTVLFPVRYNDKYYADAIAAGEFTKLAYYNDICVGAIACRLEKKESGAMRVYIMTLGVLAPYRGIGIGSNLLNHVLDMCSKQNMCEIYLHVQTNNEDAIKFYKKFGFEITDTIQNYYINIEPRDCYVVSKSFAQSEANK

SEQ ID NO: 210 - DNA, 1866 bp, Arabidopsis thaliana
atggagttctctacctcaaaacgtccggcgacgacagcgacggcggcggagtctgtacatttccgtcttctctgtccggcaacaagaactggtgcaataatcggaaaaggcggctcagtcattcgacacctccaatctgtaaccggttcaaaaatccgcgtcatcgatgatattcccgttccttcagaagagcgtgtagtgttgataatcgcacctagtggaaagaagaaggacgaatcgaatgtgtgtgattccgaaaaccctggctctgaagagcctaagcaagagaaagggagcgagtgtgcggggactagtggtggagatgacgaggaagcgccgtcgtcggcgcagatggctttacttagggttttcgaaagaatagtgtttggcgatgacgctgctacggttgatggtgatgaattggataaaggtgagagtgaaggtttgtgtaggatgattgttagaggtaatcaagtagattacttgatgagtaaaggagggaagatgattcagaagattagagaagatagtggagctattgttaggatctcatctactgatcagattcctccttgtgctttccctggagatgttgtgattcagatgaatggaaagttttcgagtgtgaagaaggcgcttttgttggttacaaactgtcttcaagaaagtggtgcacctccaacatgggacgagtgtccgtttccgcagcctggttatccgcctgagtatcattctatggagtatcatcctcaatgggatcatcctcctcctaatccaatgcctgaagatgttggaccctttaatagaccggttgttgaagaggaggttgcgttcaggttgttatgcccggctgataaagttggaagcttgattgggaaaggtggagctgtggtgcgagctctgcaaaacgaaagcggtgcgtcaatcaaggtttcggatccaactcatgattcagaggagcggattattgtgatatcggcacgagagaacttggagagaaggcactctcttgcccaagatggtgtgatgcgtgtgcataatagaattgttgagattggatttgaacctagtgctgctgttgttgcccggcttcttgtacattctccatatatcggacgtctattgggtaaagggggtcatttgataagtgaaatgaggagagcaactggtgctagcatccgcgtctttgcgaaagatcaagctacaaagtatgaatcacaacatgatgagattgttcaggtcattggtaatttgaaaactgttcaagatgctttgttccaaatattatgtaggcttcgggaagcaatgtttcctggaagacttccttttcaaggaatgggtggtccacctccgccgttcatgggtccgtatccagaaccgcctcccccatttggaccgagacaatatccagcttctccagatcgttaccattctccagtaggaccattccatgagaggcattgtcatggtcctggatttgataggccacctggtcctggatttgacaggccaccttccccaatgtcttggaccccgcagccgggaatcgatggccatcccggtggtatggttcctcctgatgtgaaccatggatttgctttgagaaatgagcccattggcagcgagaatccagtaatgacaagtgcaaatgtggagattgtgattcctcaagcatacttaggtcatgtctatggtgagaactgcagtaacctgaattacatcaaacaggtatcaggagcgaatgtggttgtgcatgatccaaaggcagggactacagaaggactggtggttgtctcaggcacatcggatcaagctcactttgctcaaagccttcttcatgcttttattctctgtggtcaatcttga

SEQ ID NO: 211 - protein, 621 aa, Arabidopsis thaliana
MEFSTSKRPATTATAAESVHFRLLCPATRTGAIIGKGGSVIRHLQSVTGSKIRVIDDIPVPSEERVVLIIAPSGKKKDESNVCDSENPGSEEPKQEKGSECAGTSGGDDEEAPSSAQMALLRVFERIVFGDDAATVDGDELDKGESEGLCRMIVRGNQVDYLMSKGGKMIQKIREDSGAIVRISSTDQIPPCAFPGDVVIQMNGKFSSVKKALLLVTNCLQESGAPPTWDECPFPQPGYPPEYHSMEYHPQWDHPPPNPMPEDVGPFNRPVVEEEVAFRLLCPADKVGSLIGKGGAVVRALQNESGASIKVSDPTHDSEERIIVISARENLERRHSLAQDGVMRVHNRIVEIGFEPSAAVVARLLVHSPYIGRLLGKGGHLISEMRRATGASIRVFAKDQATKYESQHDEIVQVIGNLKTVQDALFQILCRLREAMFPGRLPFQGMGGPPPPFMGPYPEPPPPFGPRQYPASPDRYHSPVGPFHERHCHGPGFDRPPGPGFDRPPSPMSWTPQPGIDGHPGGMVPPDVNHGFALRNEPIGSENPVMTSANVEIVIPQAYLGHVYGENCSNLNYIKQVSGANVVVHDPKAGTTEGLVVVSGTSDQAHFAQSLLHAFILCGQS

SEQ ID NO: 212 - DNA, 3228 bp, Arabidopsis thaliana
atggcttgcgccgagcagcctatcaaaaagcgtcgtctgtatgagtcaatccctgaatctcaccctccgccaccaccgcaactagaatcccaatccccttctacggtggtaagctcgttcccggctccggtgacaccgtcgcctccatctcaggaggaaattcaaacgagaagtaggaacagagaagagattcgaagagtgcatgactgctataagcgtcttaaatcttgtgttgctcagagagatggtggcggccgctctgcgaatcttgagcaagcgtatcgctccctcatctccgcttccagaggttgtactagcgttaagcgccttgtggctgatctcgttcctcgatatgcattgtactgtcctacggctattggagatgcagtgcaagctgttattgacatgcataacttcagcttggaagctttaaagagaggacaagatgctgatggtgttgcttttcaaactgctaaagcctgcatatttggtctagttgacctatgttctgctgctttatcgaagaaaacgtcatcaccaggggctcgagatatctgctctgccgtgttcagaaatgtgttaaccttctttgtgctttcttttgaggggaaaaatatcttccagatagttgataagagcgatttgaagttgcaagatcctgacgaaattttttctcagctgatgcaaaaactttcagatggaaactcgttacctttgatcaaattatcccagtttcgtgttttagctttactgaaagtattcttcaacttccctaaaaaatcaattgccacttgtttcggattcttcaattcttcatccacggaggatgtagcaacggggaggtatctcattactcatatgacagaaaagattaatgatattgatgccgctagtattgaacctgaagtagacgagaattctggtcagacaggttctaacaatatagaggctactggtaagaatgcagaagggttgaatggtgtacaagaagcatcaaacagtctaacgagctgcttgttagaaatggttattaggaagagttcctccattggtaggtgggccttctttcagtataagaaaatatgcagcctgtcatccttcgtggatatatccagtgctgttacttctctagagggaatctttggatttgttggaaaaaatatcaagttagaagattgtcaaatggacagtgacgaggatgattatggaaaattttcagtttcacatgtgaaacctcacagttctgcagacaatgatgtccgctctagtgctggatcggtttatgatgctggaggttcacgatctatggattttgagactgttgaccagagagacttgtcatgtggtagatcttcagtcccaaggggattattaaaccagcatacaccatctccttctgcaagagggccttcagatttaagaagtaactctacggatcgtaggaacaattttgttcttgcaggatcacctgtttatcaggcagtaccccatggcccttcatcagggcaaattgcttggtatttggatggggaccccactgcttttgacatttttccggcttcggggcagttgtggttaggctatttaggaccagatgaaacagaaggtcatctaaggtttcagcttgacaggtacggccctgtagaccgtttcttttttgatccagtgaaaggatttgctctagcagaatatagaagcataattgatgcaatcagagctcgagaatatctgcgagcgcaatttccttggcgcattaaatttatggatataggagtgggtgcaaggggatctttgaatggagtagcatatggttattgtactcatctgtatattggaggcatcagtagccagtgggagagggatgaaattgtccatgagtcgcggcaagccctttataaggggcctcgcatggtgactgacctgtactatgaacatgcccttctgatggagtttgatacacctgatgatgctgcaattgtaatggcccatctcaggttttttcggggagaaaagagtaaatttcatttggcatcaatcaatcgtcctttgcctcatgaagatggaggaagtcatccagagaggcaccttcaagtacctccctcatcaaaacaggatagtggttcaggagaatatgtttcccccttaatgagtacggataaccactgtaattctgtacctcctggagctacctttcagcaaaactggcctgcagctggtagcactcttgtgaattctgcacaaggagtctcaggaactcctccatgtgtgcccataccagctccgggccagcctgcagtgcctgctacaccgacatctcaaatccctccatctccgtttgttcaacaacccatttaccctcctccaaacagctcttgggatacaagatccctaatctctccaagcggtgatgctgtagcaacatcatctcagatgcaaggacctccagcgcaacaggtttcaggtcccttcatgccgcctcctgtgcatccagtctctcagccacaaggacctcaagttcagcaatttgatcaattgtacccacctccgcctttaggacattcattaccttctgtactccagccaccactacaacctcaatcccagccaccggaaccaccgcctgaaatgatgccgcctccgcctcaagctctaccacctcctttgcctcactcacacccacctctggttcctcctcctcctttttctccactgttgtccccacgcttacctccaatggtcacccagttgtgtggatcagaggcttccaaacagaacatagggcaccaatggcagggtgctttgtccaaaagtggagttcattactccaccatcattgcacagagattggaatcagacatttgcaaatatatcattggatctcccgagcctgtgcaatggccagttaaactggatatgactaagcgcacggatatgaagaacgtaaaagctacttttgcgaatacacaaccacacaaaagggaggtttgtcagttaattcctgctgctttcagcgatcgcaaagggctccaagatttcataacatacttgaagcagagagattgtgcaggagtaataaagatccctgcatcaagtcccatgtgggcaaggcatctcttcattcttccacactcgcaagagacatgttccttgctttctgtttccccatcttcctcggaatgcttgatcggtttggttttgccaaaggatacaaatgctgaggcctcatga

SEQ ID NO: 213 - protein, 1075 aa, Arabidopsis thaliana
MACAEQPIKKRRLYESIPESHPPPPPQLESQSPSTVVSSFPAPVTPSPPSQEEIQTRSRNREEIRRVHDCYKRLKSCVAQRDGGGRSANLEQAYRSLISASRGCTSVKRLVADLVPRYALYCPTAIGDAVQAVIDMHNFSLEALKRGQDADGVAFQTAKACIFGLVDLCSAALSKKTSSPGARDICSAVFRNVLTFFVLSFEGKNIFQIVDKSDLKLQDPDEIFSQLMQKLSDGNSLPLIKLSQFRVLALLKVFFNFPKKSIATCFGFFNSSSTEDVATGRYLITHMTEKINDIDAASIEPEVDENSGQTGSNNIEATGKNAEGLNGVQEASNSLTSCLLEMVIRKSSSIGRWAFFQYKKICSLSSFVDISSAVTSLEGIFGFVGKNIKLEDCQMDSDEDDYGKFSVSHVKPHSSADNDVRSSAGSVYDAGGSRSMDFETVDQRDLSCGRSSVPRGLLNQHTPSPSARGPSDLRSNSTDRRNNFVLAGSPVYQAVPHGPSSGQIAWYLDGDPTAFDIFPASGQLWLGYLGPDETEGHLRFQLDRYGPVDRFFFDPVKGFALAEYRSIIDAIRAREYLRAQFPWRIKFMDIGVGARGSLNGVAYGYCTHLYIGGISSQWERDEIVHESRQALYKGPRMVTDLYYEHALLMEFDTPDDAAIVMAHLRFFRGEKSKFHLASINRPLPHEDGGSHPERHLQVPPSSKQDSGSGEYVSPLMSTDNHCNSVPPGATFQQNWPAAGSTLVNSAQGVSGTPPCVPIPAPGQPAVPATPTSQIPPSPFVQQPIYPPPNSSWDTRSLISPSGDAVATSSQMQGPPAQQVSGPFMPPPVHPVSQPQGPQVQQFDQLYPPPPLGHSLPSVLQPPLQPQSQPPEPPPEMMPPPPQALPPPLPHSHPPLVPPPPFSPLLSPRLPPMVTQLCGSEASKQNIGHQWQGALSKSGVHYSTIIAQRLESDICKYIIGSPEPVQWPVKLDMTKRTDMKNVKATFANTQPHKREVCQLIPAAFSDRKGLQDFITYLKQRDCAGVIKIPASSPMWARHLFILPHSQETCSLLSVSPSSSECLIGLVLPKDTNAEAS

SEQ ID NO: 214 - DNA, 2634 bp, Arabidopsis thaliana
atggtaccatcagagccgcctaatcctgttgggggtggtgaaaatgttccgccttcgatattaggaggacaaggaggagctcctcttccttctcaaccagcatttccttcacttgtctctccgcgtactcagtttggtaacaatatgagtatgagtatgcttgggaatgctccaaatatatcttctcttctcaataatcagtcttttgtaaatggtatccctggttctatgatttctatggatacaagtggtgctgagtctgacccgatgtctaacgtcgggtttagtggtttgtcgtcttttaatgcgtcgagtatggtgtctccgcgctcatcaggtcaagttcagggtcagcagttttcgaatgtttcggctaaccagttgttggctgagcaacaacggaataagaaaatggagacgcagagttttcaacatggtcagcagcagtcaatgcagcagcagttttcgacagtgcgtggtggtggattagcaggtgtgggacctgttaagatggagcctggtcaggtttcgaatgatcagcagcatggtcaagtacaacagcagcaacagaaaatgttgagaaacctagggtcagttaagttggaaccgcagcaaattcaggccatgagaaatttggcccaagtgaaaatggaacctcaacattctgagcagtcattgtttctccaacaacagcagaggcaacaacagcaacaacaacaacaacaatttcttcaaatgccggggcaatctccgcaggctcaaatgaacatatttcagcagcagagacttatgcaacttcaacaacagcaactcttgaaatctatgcctcaacagcgtcctcaattaccacagcagttccaacagcagaatttacctctaaggccacctctgaaaccagtgtatgaacctggcatgggtgctcagcgtcttacacagtatatgtacagacaacaacataggcctgaagacaataatatcgagttctggagaaaatttgtagctgagtactttgctcctaatgccaaaaagagatggtgcgtctctatgtatggcagtggcaggcaaacaacaggcgttttccctcaggatgtgtggcactgtgagatatgtaaccgaaagcctggacgtggttttgaggcaaccgccgaagtccttccgcggctgtttaagattaagtatgagagtgggacgttagaagaactgttatatgtagatatgccaagggagtcccagaattcatctggccaaattgtcctggagtatgcaaaagcaacacaagagagtgtctttgagcatcttcgggttgttcgtgatggccaacttcgaatagtcttctcgccagatcttaagatattctcctgggaattttgtgctcggcggcatgaagagcttattccacgaagacttttgataccgcaggttagtcagcttggatcggcagctcagaaatatcaacaagctgctcaaaatgcaacaacagattctgctcttccggagctacaaaataattgcaatatgtttgttgcatctgctagacaattggcaaaggccctggaagtaccacttgtgaatgatttgggatacacaaagagatatgttcggtgtttgcagatctcagaggtggtaaatagtatgaaggacctgatagattatagcagagaaacacgaacaggaccaatcgagagtttagccaagtttcctcggagaacaggcccttcatctgcactgcctggtccttctcctcagcaagccagcgaccagcttaggcagcagcagcaacaacaacagcagcagcagcaacagcaacaacaacaacaacaacaacagcagcagcagcaaacagtttcccagaatacaaacagtgatcaaagtagtaggcaagttgcactaatgcagggtaatccaagcaatggtgtaaattatgcctttaatgcagcctctgcatccacttccaccagcagcatcgcagggctcatccaccagaattcaatgaagggaagacatcagaatgctgcttacaatcctccaaacagcccctatggaggaaactctgttcagatgcaatcacctagttcctcgggtaccatggtgccatcatcatcgcagcaacaacacaacctgccaacatttcagtctccaacatcctcatctaataacaataatccctctcaaaacgggataccatctgttaatcacatgggttccacaaactcaccagcaatgcaacaggcaggtgaggttgatggaaacgagtctagctcggtgcagaagatactgaatgaaatcctgatgaacaaccaagctcataataatagctcaggaggaagcatggttgggcatgggtctttcgggaatgatgggaagggtcaagctaatgtaaatagttctggtgttttactgatgaatggccaagtgaacaacaacaacaacacaaatattggaggtgctggtgggtttggtggtgggattggtcaatccatggcagcaaacggaatcaataatataaacggtaacaatagtctcatgaacggaagagttgggatgatggtgcgggatccaaacggtcaacaggatttaggaaaccaacttttaggagcagtgaatggtttcaacaattttgattggaacgcgtga

SEQ ID NO: 215 - protein, 877 aa, Arabidopsis thaliana
MVPSEPPNPVGGGENVPPSILGGQGGAPLPSQPAFPSLVSPRTQFGNNMSMSMLGNAPNISSLLNNQSFVNGIPGSMISMDTSGAESDPMSNVGFSGLSSFNASSMVSPRSSGQVQGQQFSNVSANQLLAEQQRNKKMETQSFQHGQQQSMQQQFSTVRGGGLAGVGPVKMEPGQVSNDQQHGQVQQQQQKMLRNLGSVKLEPQQIQAMRNLAQVKMEPQHSEQSLFLQQQQRQQQQQQQQQFLQMPGQSPQAQMNIFQQQRLMQLQQQQLLKSMPQQRPQLPQQFQQQNLPLRPPLKPVYEPGMGAQRLTQYMYRQQHRPEDNNIEFWRKFVAEYFAPNAKKRWCVSMYGSGRQTTGVFPQDVWHCEICNRKPGRGFEATAEVLPRLFKIKYESGTLEELLYVDMPRESQNSSGQIVLEYAKATQESVFEHLRVVRDGQLRIVFSPDLKIFSWEFCARRHEELIPRRLLIPQVSQLGSAAQKYQQAAQNATTDSALPELQNNCNMFVASARQLAKALEVPLVNDLGYTKRYVRCLQISEVVNSMKDLIDYSRETRTGPIESLAKFPRRTGPSSALPGPSPQQASDQLRQQQQQQQQQQQQQQQQQQQQQQQQTVSQNTNSDQSSRQVALMQGNPSNGVNYAFNAASASTSTSSIAGLIHQNSMKGRHQNAAYNPPNSPYGGNSVQMQSPSSSGTMVPSSSQQQHNLPTFQSPTSSSNNNNPSQNGIPSVNHMGSTNSPAMQQAGEVDGNESSSVQKILNEILMNNQAHNNSSGGSMVGHGSFGNDGKGQANVNSSGVLLMNGQVNNNNNTNIGGAGGFGGGIGQSMAANGINNINGNNSLMNGRVGMMVRDPNGQQDLGNQLLGAVNGFNNFDWNA

SEQ ID NO: 216 - DNA, 777 bp, Arabidopsis thaliana
atgaacgggacatcgcccgacgaatctcccgattcgacaactcagcggatcgattcgttcaacggcgagcagagagtctacttcgttcccttgaggtggtggaaagatgcgcaagattcaatgccttctgaatcagttgaaaaaagagagatcttgtatacagcaagttgcgggtcgtcttatggaggcccaatgaagttgataaataacatttttaactctgatattttgttcgatctgaggagagaaggagatgcgttacagaatggtgaaacgggagaagcaagcgtctcaggcagggactttgctttggtctcaagtgatatgtggctgcaggcactaaaatgtatccgatcaaatgattcttttatggaatttttcgtattttctgcatctgttcattctttggagaacgagtttttaaagaagaggctgaggtatcatgatgataaaaatactgagaaaggcgtaaaaagtttctcggctggaggagttgacagaggtgatgtttatcctgtacaactcaggctctccgttttgcaggaaaccaattcattggcggtcaaaatttgcaaaaaggacaattcagttgaatgcttcagaagagcatgcaagatattcagtttggattctgagcagttgcgcatttgggatatttctggccaaacaaccttgtttttcgaaagtgatgtgagcaattccaaggattgtcaacaacaagcagatcaggaagtaagtgtgatgctttttgagttgaatgcggatattgctccatag

SEQ ID NO: 217 - protein, 258 aa, Arabidopsis thaliana
MNGTSPDESPDSTTQRIDSFNGEQRVYFVPLRWWKDAQDSMPSESVEKREILYTASCGSSYGGPMKLINNIFNSDILFDLRREGDALQNGETGEASVSGRDFALVSSDMWLQALKCIRSNDSFMEFFVFSASVHSLENEFLKKRLRYHDDKNTEKGVKSFSAGGVDRGDVYPVQLRLSVLQETNSLAVKICKKDNSVECFRRACKIFSLDSEQLRIWDISGQTTLFFESDVSNSKDCQQQADQEVSVMLFELNADIAP

SEQ ID NO: 218 - DNA, 963 bp, Arabidopsis thaliana
atgagacctcctctaactggaagtggtggtgggttcagtggtggaagagggcgtggtggatacagtggtggtagaggtgacggtggattcagtggtggtcgaggtggcggtggtagaggaggaggaagaggtttcagcgaccgtggtggtcgcggcagaggaagaggaccaccacgtggtggtgctcgcggcggcagaggaccagctggccgtggaggcatgaaaggaggaagcaaagtgattgtggaacctcacagacacgcaggagtgttcattgcaaagggtaaagaagatgcccttgttaccaagaatttggttcctggtgaagctgtctacaacgagaagagaatctctgttcagaacgaagatggaaccaagactgaatacagagtttggaatcctttccgttcgaagttggctgctgctattcttggtggtgttgataacatctggattaaacctggtgctaaagttctataccttggtgctgcttctggaaccacagtctctcatgtgtctgatcttgttggccctgaggggtgtgtgtacgcggttgagttttctcatagaagtggtagagatttggtgaacatggcaaagaagagaaccaatgttattccaatcatcgaggatgctagacacccagctaaatacagaatgcttgtaggcatggttgatgttatcttctctgatgttgctcagccagatcaggctaggatcttggctttgaatgcatcatacttcctcaagtcaggaggacactttgtgatctcaataaaggcaaactgtatcgactccaccgttccagcagaagctgtgttccagactgaagtgaagaagcttcaacaggagcaattcaaaccagctgagcaagtgacgcttgagccatttgagcgtgaccatgcatgtgtcgttggtggctaccgtatgcctaagaagccaaaggctgctactgctgcttag

SEQ ID NO: 219 - protein, 320 aa, Arabidopsis thaliana
MRPPLTGSGGGFSGGRGRGGYSGGRGDGGFSGGRGGGGRGGGRGFSDRGGRGRGRGPPRGGARGGRGPAGRGGMKGGSKVIVEPHRHAGVFIAKGKEDALVTKNLVPGEAVYNEKRISVQNEDGTKTEYRVWNPFRSKLAAAILGGVDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASYFLKSGGHFVISIKANCIDSTVPAEAVFQTEVKKLQQEQFKPAEQVTLEPFERDHACVVGGYRMPKKPKAATAA

SEQ ID NO: 220 - DNA, 2505 bp, Arabidopsis thaliana
atggttgataacagtaacaataagaagaggaaagagttcatcagtgaagcagacatcgccactcttttgcagagatatgatactgtgacgatactgaagttgctacaagaaatggcgtattatgctgaagcaaagatgaattggaatgagttagtgaagaagacaagtactggaattactagtgctagagaatatcagttgctttggcggcatcttgcttatagagattctctcgtccctgtgggaaataatgctcgagttctggatgatgatagtgatatggagtgtgaattggaagcatcccctggagttagtgttgatgtagtaacggaagctgttgcgcatgtgaaagtgatggctgcttcctatgtgccaagtgagtccgatattcccgaagactcaacggttgaggctcccttgaccattaacataccttacagcctgcatagggggcctcaggaaccatcagactcatattggtcatcaagagggatgaatatcacctttcctgtttttcttccgaaagcagctgaaggacataatgggaatgggttagccagtagcttggctcctcggaagagaagaaaaaaatggtcagctgaggaggatgaggagctgattgctgctgttaagcgacatggtgaaggcagctgggcccttatctctaaggaagaatttgaaggagagcgaacagcctcacaactctcacagcggtggggggctataaggagaaggactgatacttcaaacacttctacccaaactggcctacagcgaacagaagcacaaatggcagctaatcgtgcattatctttagcggtgggaaatcggttaccctcaaaaaaacttgcagtaggtatgactccaatgctgtcatccggtaccatcaagggagcacaagccaatggtgccagcagtggtagtacattgcaaggtcaacaacagcctcagccacaaattcaagcattatcacgggcaacaacatcagtgccagttgcaaaatctcgagttcctgtaaagaaaacaacagggaactccacttcgagagcagacctaatggtaactgctaattcagtagctgctgcagcctgtatgtctggcctggcaaccgctgtaacagtgcctaagattgaaccaggaaagaatgctgtttctgcgttggtgccgaagactgaacccgtaaaaaccgcttccacagtttctatgcctcgtccttcaggtatatcatcagcactgaatactgagcctgtaaaaaccgctgtggcagcctctttgcctcgttcatcaggtattatttcagcaccaaaggttgagcctgtaaaaaccgctgcttcagcagcctctttgcctcgtccatcaggaatgatatcagcaccaaaggttgagcctgtgaaaaccaccgcctctgtagcctctttgcctcgtccatcaggtattatttcagctccaaaggctgagcctgtaaaaaccgctgcttctgcagcctcttcgcctcgtccatcaggaatgatatcagcaccaaaggttgagtctgtgaaaaccaccgcctctatgcctcgtccatcaggtattatatccgcaccaaaggctgagcttgtaaaatccgccgcttctgcagcctctttgccttgtacatcaggtattatatcttcaccaaaggctgagcttgtaaaatccgccgcttctgcagcctcttttcctcgcccatcaagtatgctatcagcaccaaaggctgacccagtaaagattgttcctgctgctgccactaacactaaatcggttggacctttgaatttaaggcatgcagtcaatggaagcccaaaccacacgataccttcatcaccctttactaagcctttacatatggctcctctctccaaaggatctacaatccagagtaattcagttcctcctagttttgcatcgtcaaggttggtccccacacagagagctcctgcggctactgttgtcacgccacaaaagccaagtgtggtagcggcagctactgttgtcacgccacaaaagccaagtgtgggagcagcagctactgttgtaacgccacaaaagccaagtgtgggagcagcagctaatgttgtaacgccacaaaagccaagtgtgggatcagcagctactgttgtaacgccacaaaagccaagtgtgggagcagcagttaccgtcacttccaagccggttggtgtacagaaagagcaaactcagggaaacagagcaagccccttggttacagcaacacttccgccaaataaaaccatcccagcaaattcagtgattggcacagcaaaagcggtggctgcgaaagtggagactcctcctagccttatgcctaagaaaaatgaagtagttggcagttgcaccgataaaagttcattggataaaccacctgagaaagaaagtactaccacggtgtcacctctagctgtagctgcgactaaatcaaaacccaaagatgaagcaaccgtgacagggaccggactgaaggagttgtag

SEQ ID NO: 221 - protein, 834 aa, Arabidopsis thaliana
MVDNSNNKKRKEFISEADIATLLQRYDTVTILKLLQEMAYYAEAKMNWNELVKKTSTGITSAREYQLLWRHLAYRDSLVPVGNNARVLDDDSDMECELEASPGVSVDVVTEAVAHVKVMAASYVPSESDIPEDSTVEAPLTINIPYSLHRGPQEPSDSYWSSRGMNITFPVFLPKAAEGHNGNGLASSLAPRKRRKKWSAEEDEELIAAVKRHGEGSWALISKEEFEGERTASQLSQRWGAIRRRTDTSNTSTQTGLQRTEAQMAANRALSLAVGNRLPSKKLAVGMTPMLSSGTIKGAQANGASSGSTLQGQQQPQPQIQALSRATTSVPVAKSRVPVKKTTGNSTSRADLMVTANSVAAAACMSGLATAVTVPKIEPGKNAVSALVPKTEPVKTASTVSMPRPSGISSALNTEPVKTAVAASLPRSSGIISAPKVEPVKTAASAASLPRPSGMISAPKVEPVKTTASVASLPRPSGIISAPKAEPVKTAASAASSPRPSGMISAPKVESVKTTASMPRPSGIISAPKAELVKSAASAASLPCTSGIISSPKAELVKSAASAASFPRPSSMLSAPKADPVKIVPAAATNTKSVGPLNLRHAVNGSPNHTIPSSPFTKPLHMAPLSKGSTIQSNSVPPSFASSRLVPTQRAPAATVVTPQKPSVVAAATVVTPQKPSVGAAATVVTPQKPSVGAAANVVTPQKPSVGSAATVVTPQKPSVGAAVTVTSKPVGVQKEQTQGNRASPLVTATLPPNKTIPANSVIGTAKAVAAKVETPPSLMPKKNEVVGSCTDKSSLDKPPEKESTTTVSPLAVAATKSKPKDEATVTGTGLKEL

SEQ ID NO: 222 - DNA, 1569 bp, Arabidopsis thaliana
atggcgatgtatgttatctacgagtcttcttccggctatggtctcttcgaggttcacggactagatgagatcggacagaacactgaggcggttcggacttctgtctccgacctcagtcgctttggccgtgttgttcagctcacagcgtttcatccctttgagtctgctctcgatgctctcaaccaagtcaacgccgtctctgaaggtgttatgactgatgagcttagaagttttctggagttgaatcttcctaaggtcaaggagggaaagaaacccaagttcagtttaggattggctgagcctaaactcggttcacatatatttgaagctactaaaatcccatgccagagcaatgagtttgttcttgagcttctcagaggtgttcgccagcattttgataggtttatcaaggacttaaagcctggtgatcttgaaaaatctcagcttggattagctcacagctacagcagagccaaggtgaagttcaatgttaaccgagtggataacatggttattcaagctatcttcatgcttgacacgcttgataaggatatcaattcctttgccatgagagtcagggaatggtattcgtggcacttccccgaactagtgaagatagtcaatgacaactatctttacgcccgtgtttcaaagatgattgatgacaagtcaaagttgactgaagatcacatccccatgcttactgaagtcttaggggatgaagataaggcaaaggaggtcatcgaagctggaaaagcatccatgggctcggatttatcaccgcttgacttaatcaacgtacagacctttgctcagaaagttatggaccttgctgactacaggaagaagctctatgattatcttgtcactaagatgagcgacattgcccctaatttggctgctttgattggagaaatggtcggtgcccgtttgatttcacatgctggaagtctgactaaccttgctaaatgcccatcttccaccctccagattcttggagccgagaaggctcttttcagggcacttaaaacacgtggaaacactcccaagtatggattgattttccattcttccttcattggccgagcatctgctaagaacaagggccgtatcgctcgttatcttgcaaacaagtgctctatagcatcccggattgattgttttgctgatggtgcaactactgcttttggtgagaagcttcgcgaacaagttgaggaaaggctagaattttatgacaaaggtgttgccccacgcaagaacgtggatgtaatgaaggaggtgatagagaatctaaagcaagaagaggaagggaaggagccagttgatgcctcggtgaagaaaagcaagaagaagaaggcaaagggtgaagaagaagaagaggtggtggcaatggaggaggacaagtcagagaaaaagaagaagaaagagaagaggaagatggagactgcagaggagaacgagaaatcagagaagaagaagacaaagaagagtaaagctggaggagaagaggagactgatgatggtcacagcaccaagaagaagaagaagaagtctaagagcgctgaatag

SEQ ID NO: 223 - protein, 522 aa, Arabidopsis thaliana
MAMYVIYESSSGYGLFEVHGLDEIGQNTEAVRTSVSDLSRFGRVVQLTAFHPFESALDALNQVNAVSEGVMTDELRSFLELNLPKVKEGKKPKFSLGLAEPKLGSHIFEATKIPCQSNEFVLELLRGVRQHFDRFIKDLKPGDLEKSQLGLAHSYSRAKVKFNVNRVDNMVIQAIFMLDTLDKDINSFAMRVREWYSWHFPELVKIVNDNYLYARVSKMIDDKSKLTEDHIPMLTEVLGDEDKAKEVIEAGKASMGSDLSPLDLINVQTFAQKVMDLADYRKKLYDYLVTKMSDIAPNLAALIGEMVGARLISHAGSLTNLAKCPSSTLQILGAEKALFRALKTRGNTPKYGLIFHSSFIGRASAKNKGRIARYLANKCSIASRIDCFADGATTAFGEKLREQVEERLEFYDKGVAPRKNVDVMKEVIENLKQEEEGKEPVDASVKKSKKKKAKGEEEEEVVAMEEDKSEKKKKKEKRKMETAEENEKSEKKKTKKSKAGGEEETDDGHSTKKKKKKSKSAE

SEQ ID NO: 224 - DNA, 3495 bp, Arabidopsis thaliana
atggtctccggaggtggtagcaaaaccagcggtggagaggcagcttcctcaggccatcgccgaagtcgtcacaccagcgctgcagaacaagctcagtcgtcagcaaacaaagccctaaggtcacagaatcagcagccacaaaaccacggtggcggaacagagtccacaaacaaagctattcaacagtacactgtcgacgcgagactccacgccgtcttcgaacaatccggagagtcaggtaagtcgtttgattactcacagtctcttaaaacggcgccgtacgattcctccgtaccagagcagcagatcacagcttatctctcccggatccaacgcggtggctatacccagccttttggctgcttgatcgccgtcgaagaatccactttcacaatcatcggttacagtgaaaatgcgcgggaaatgctagggctcatgtctcaatctgtaccaagcatcgaggacaaatcagaggttttaacgattggtacggatttgcgatctctcttcaagtcatcgagctaccttctcctcgagcgcgcgttcgtggctcgagagatcacgcttctgaatcctatttggattcactctaacaacactggtaaacctttctacgcgattctccacagggttgatgttggaattttgatcgatttagagccggctcgaaccgaagatccggcactttcaatcgccggagcagtccaatcgcagaaacttgcggtacgtgcgatttctcatttacaatcgttgcctagcggcgacattaagcttctatgtgacactgttgtggaaagcgttagagatcttactggctacgaccgcgttatggtgtacaagtttcatgaagatgaacatggtgaagtcgtagccgagagtaaacggaacgatttagagccttacattggtctgcattatcccgctactgatattcctcaggcatctcggttcttgttcaagcaaaaccgtgttaggatgatagtagattgctatgcgtcaccggttcgtgtggttcaagacgataggctcacgcagtttatatgcttggtgggttcgactttgcgagctcctcatggctgtcatgctcaatacatgactaacatgggctctattgcgtcgttagctatggcagttataataaatggaaacgaagaagatggtaatggggttaatactggaggaagaaactcgatgaggctttggggtttagttgtttgccatcacacatcagctcgttgcataccttttcctttgaggtacgcttgtgagtttcttatgcaggcctttggcttacagctaaacatggagttgcagttagccttgcaggtgtctgaaaaacgcgttctgagaatgcagacactattatgtgatatgcttctacgtgactcaccagcggggattgtcacgcagaggcctagtatcatggatttagtaaaatgtaatggtgcggcatttctttaccaagggaagtattatccgttgggtgtgactccaactgattctcagattaatgacattgtggagtggttggttgctaaccattctgattctaccgggttaagcacagatagtttaggcgatgcgggttatcctcgggcagctgctttgggagatgctgtgtgcggtatggcagtcgcgtgtatcacaaaaagggacttccttttctggtttcggtctcatactgagaaagaaatcaaatggggaggggctaagcaccatcctgaggacaaagatgatggtcagcggatgaatccgcgttcttcgttccagacttttctcgaagttgttaagagccgatgtcagccatgggaaactgctgaaatggacgccattcactcgctccagcttattctaagagactctttcaaagagtctgaagcgatggactctaaagctgctgcagctggggcggttcagccacatggagatgatatggtacagcaagggatgcaggagataggtgcagttgcaagagagatggttaggctcattgagactgcgacggttcctatatttgctgtggacatagacggttgcatcaatgggtggaacgccaagatcgcagagctgaccggtctttctgttgaagacgctatgggaaagtcgctggttcgcgaattgatatacaaagagtacaaagaaacagttgataggcttctttcttgtgctctcaaaggggatgaaggcaagaatgtggaggtcaagctgaaaacttttggttccgagctacaaggaaaagcaatgtttgtggttgtcaacgcatgttcaagcaaggactacttaaacaacatcgttggagtctgctttgttggacaagatgtaactggtcataaaattgttatggacaagttcatcaacatacaaggtgattacaaggccatcatccatagcccgaaccctctgatccctccaatctttgcagcggatgagaatacgtgctgccttgagtggaacactgcaatggaaaagctcacaggctggcctcgcagcgaagtgattggaaaattacttgttagggaagtatttgggagctattgcagactaaagggtcctgatgcgttaactaagttcatgatcgtcttgcataacgcgatcggtggccaagatactgataaattcccattcccgttctttgatcgcaaaggggaattcattcaggctctcctgactttgaacaaacgggtcagcatcgatggcaaaatcattggggctttctgttttttgcagataccgagtcccgagctgcagcaagctctagaagttcagaggaggcaggagagtgaatatttctcaaggaggaaagagttggcttacattttccaagttataaagaatccattgagtggattgcgtttcacaaattcattgctggaagacatggatttaaacgaggatcagaagcagcttcttgaaacgagtgtttcatgtgagaagcagatctcaaagattgtaggagacatggacgtcaaaagcatagatgacggttcatttctgctagagagaacagagttcttcattggcaatgtcacaaatgcagtggtaagccaagtcatgttggtggtgagagagagaaatctccagctgatccgtaacattcccacggaggtcaaatccatggctgtctacggtgaccagataaggctccaacaggttctcgcagaatttctgctaagtattgtccgttatgcacccatggaaggctcggtagagctccatctatgcccgactctgaaccaaatggctgacggattctccgctgtacgtttggagttcagaatggcgtgtgcaggggaaggtgtgccgccagagaaagtgcaagacatgttccatagtagccgatggacaagtccagaaggattaggactaagcgtttgcagaaagattttgaagctgatgaacggaggggttcagtacataagagaattcgaacgctcttatttcctaatcgttatcgaactcccggttcctctaatgatgatgatgccctcttcatga

SEQ ID NO: 225 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQFICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYPLGVTPTDSQINDIVEWLVANHSDSTGLSTDSLGDAGYPRAAALGDAVCGMAVACITKRDFLFWFRSHTEKEIKWGGAKHHPEDKDDGQRMNPRSSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSCALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSIDGKIIGAFCFLQIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 226 - DNA, 3225 bp, Arabidopsis thaliana
atggcagactctcggaatggtaatgcccgagcccctcctagtggagtgcctccaaaagctgggaatacttattccatagatgttaaaaactttatctcacgtgcaagagcattgtatgaacactggaagaagcacagtgcagacttatggggatctgccgacgctcttgccattgctacccctcctgcttctgatgatctgcgttacctgaaatcttcagcgttgaatatttggcttcttgggtatgagtttccagatacaattatggtttttaccaagaagcagatccatttcctgtgtagtaggaacaaggcttctctacttgaagttgtgaaaaaacctgcacatgatgagttgaagcttgatgttatcatgcatgttaagcctaagggtgatgatggaacagggctgatggatgccatatttcgtgccatccgtgatctatcccggggtgatggaaatgattcacaagttgttggacacattgctcgtgaagcccctgaaggtaagcttctggagacatggactgagaggctaaagaatgcaaacttccagttcgtagatataactggggggctgtctgatctatttgctgttaaagacgatactgaggtcatgagtgtgaagaaagctgcgtatctagcctacagtgtgatgaaaaatgttgttgttccaaatcttgagagtgccattgatgaggagaaagacgtcacccactctgccctgatggatctcactgagaaagcgatacttgagccaactaaggccagtgtgaaactgaagccagagaatgttgacatatgctaccctccgatatttcaaagcggaggcaagtttgatctcaaaccaagtgctgcaagcaatgatgaactgctcacttatgatccagcgagtatcataatatgtgctgttggtgctaggtataatagttattgctcaaatgttgccaggacctacctaatagatgcaacttctctccagagcaaggcatatgaggttcttctcaaggcacatgaggctgctattgatgctttgaggtcaggaagaaagataaacactgtctatcaagctgccctttctgttgttgaaaagaatgcccctgagttcgttgacaagctaactaaatctgctgggactggtatcggtctggaattccgagagtcaggattaaatataaatgcaaagaatgataaagtattgagaccgaagatggcatttaatgtgtctcttggtttccagaacttggaatgtgagtcagaaagccgcagcaagaacaagaaattctcacttttgctagctgacacagttctcgtcacagatcagaaaccggagcttttaaccaagtgctctaaatctgttaaggatgtggcttactcctttaaagaggatgaagaagaagagaaaccgcgcaagaaagctaggaccagtggttctgagaactacattaccaagacagctcttagatcagatgatcatgtggtgtctaaagaagagctacggaagcagcaccaggcagagctggcacgccagaaaaatgaagaaactgccagaaggcttgctggtgacagttctggggcgggagacagccggtctactgcaaagacttcagctgatgtggttgcctacaagaatgttaacgacatgccccataaggaattgatgatccaggttgatacgagaaacgaggctgtattgttacccatctatgggagcttggttccattccatgtggctacaataagaacagtgtcaggcaatcaagataccaaccgaaactgctacatccgtatcattttcaatgtcccgggtacacccttcaaccctcatgactcaaactctttgaaaaaccagggtgctatctacctcaaggaggtttcattccggaccaaggattcaaggcatagcagcgaagtaactcaacagattaagacccttagacggcaagtcatggccagggagtcagagagagctgaaagggcgacattggtgacccaagagaaacttcagcttgcagggaacaagttcaaacccctcaggttgtccgagctgtggatccgtccgccttttagtgggcgcaagaagattcctgggacactcgaagctcatgcaaatggtttcaggtattcaactaccaggcctgacgagcgcgtggatgtcctgtttgcaaacataaagcatgcgtttttccagcctgctgagaaggagatgatcaccctccttcattttcatttgcacaaccacatcatggtaggaactaagaagacaaaggacgttcaattctatgtggaggtaatggatgttgtgcagtctttaggtggtgggaggagatcagcctatgatccagatgagattgacgaagaacagagggagcgcgataggaagaacaagatcaacatggatttcaatcattttgcaaaccgggtgaatgatatgtggcaactaccacagtttgcaagtctggaccttgagtttgatcaacctctgagagagcttggtttccatggtgttccgcacaagacatctgcattcataataccgacctccagctgcttagttgagctgatagaatacccgttcctcgtggtgagtctgagtgagattgagattgtgaatcttgagagagttgggtttgggcagaagaactttgacatggccatcatcttcaaggacttcaaaaaagatgttctcagggttgactcagttcccacaagctccctagaggggataaaggagtggctagacaccacagatataaagtactacgagagcaaactgaatctgaactggagacagatcctaaagacgatcacagatgatccgcagagctttatagatgatggaggatgggagtttctgaacctggacggaagcgattcagaatctggcgggtctgaggagtcagacaaaggatatgaaccatcagatgtagaggttgagtctgagtcagaggacgaggcttcagagagtgagtcactggtggagtcagacgatgatgaagaagaggactcagagcaagagtcagaggaagagaaaggtaagacttgggatgaactggagagagaagctactaatgcagacagagagcatggagttgagtctgatagcgaggaagagaggaagagaagaaagatgaaagcgtttgggaaatcgcgacctggaactagcggtggaggtggtagtagcagcatgaagaacatgccaccatctaaacgcaagcacaggtga

SEQ ID NO: 227 - protein, 1074 aa, Arabidopsis thaliana
MADSRNGNARAPPSGVPPKAGNTYSIDVKNFISRARALYEHWKKHSADLWGSADALAIATPPASDDLRYLKSSALNIWLLGYEFPDTIMVFTKKQIHFLCSRNKASLLEVVKKPAHDELKLDVIMHVKPKGDDGTGLMDAIFRAIRDLSRGDGNDSQVVGHIAREAPEGKLLETWTERLKNANFQFVDITGGLSDLFAVKDDTEVMSVKKAAYLAYSVMKNVVVPNLESAIDEEKDVTHSALMDLTEKAILEPTKASVKLKPENVDICYPPIFQSGGKFDLKPSAASNDELLTYDPASIIICAVGARYNSYCSNVARTYLIDATSLQSKAYEVLLKAHEAAIDALRSGRKINTVYQAALSVVEKNAPEFVDKLTKSAGTGIGLEFRESGLNINAKNDKVLRPKMAFNVSLGFQNLECESESRSKNKKFSLLLADTVLVTDQKPELLTKCSKSVKDVAYSFKEDEEEEKPRKKARTSGSENYITKTALRSDDHVVSKEELRKQHQAELARQKNEETARRLAGDSSGAGDSRSTAKTSADVVAYKNVNDMPHKELMIQVDTRNEAVLLPIYGSLVPFHVATIRTVSGNQDTNRNCYIRIIFNVPGTPFNPHDSNSLKNQGAIYLKEVSFRTKDSRHSSEVTQQIKTLRRQVMARESERAERATLVTQEKLQLAGNKFKPLRLSELWIRPPFSGRKKIPGTLEAHANGFRYSTTRPDERVDVLFANIKHAFFQPAEKEMITLLHFHLHNHIMVGTKKTKDVQFYVEVMDVVQSLGGGRRSAYDPDEIDEEQRERDRKNKINMDFNHFANRVNDMWQLPQFASLDLEFDQPLRELGFHGVPHKTSAFIIPTSSCLVELIEYPFLVVSLSEIEIVNLERVGFGQKNFDMAIIFKDFKKDVLRVDSVPTSSLEGIKEWLDTTDIKYYESKLNLNWRQILKTITDDPQSFIDDGGWEFLNLDGSDSESGGSEESDKGYEPSDVEVESESEDEASESESLVESDDDEEEDSEQESEEEKGKTWDELEREATNADREHGVESDSEEERKRRKMKAFGKSRPGTSGGGGSSSMKNMPPSKRKHR

SEQ ID NO: 228 - DNA, 1335 bp, Arabidopsis thaliana
atgccaatgtttcagccttctaagaacggtgggtttgatgggcatatcttagatctacactcggcggttaaagacggtgttcttggcggcggagatgggaaatttctggtggttgttaccgatgagaagaagaaattggatttgaaggagatgatttctgagctggaattacctgaaataccctctgttttcatctgtcctatctctctagagccgatgcaagatccagtgaccttgtgtactggtcaaacctacgagaggtccaacattctcaaatggttcaatatagggcattgtacttgcccaacgacgatgcaagagctttgggatgatttggtcactcctaacaagactcttcaccaattgatctacacttggttttcacagaagtatgttttgatgaagaaacgatctgaagatgtgcaaggacgtgctattgagattctgggtacgttgagaaaggctaaagggaaagcaaaggttcatgctttaagcgagcttaagcaagttgtgatggctcacgctattgctaagaagactgttgttgatgaaggtggagtctttgtgatctcttctcttttaagtccttttacttctcacgctgttggatctgaggctatagctattcttgttaatcttgagcttgactctgattccaaagctggattgatgcaaccagctagggtctcgttgatggttgatatgttgaatgatggttcgattgaaactaagatcaattgtgctagattgattggaaggttggtggaggagaaaggttttagagcagagcttgtttctagtcatagtttgcttgttggattaatgagattggttaaagataggagacgaagaaacggcgtttcgcctgcgttaacgctgctcaaatcggtttctgttcataaacaagttaggaacttgttggttaggattggtgcagttcctcaattggttgatgttttgccatgtttggatgtggagtgtttagagtcagctcttttcgtgttggattcgttatgtttagaaagcgaaggcagaattgctttgaaagattcggttaacacgattccgcataccgttaggttactgatgaaggtatcagagaaatgcacaaactatgcgatatcgattctttggtcagtttgcaaattagcttctgaagaatgttcatctcttgctgttgaagttggtttggctgcaaagcttttgcttgtgatacaaagtggatgtgatccagctttgaagcaacgttcagctgagctattgaagttatgtagtctacattattcagactcaatgtttatctccaaatgtaaactcacaagaactatccaataa

SEQ ID NO: 229 - protein, 444 aa, Arabidopsis thaliana
MPMFQPSKNGGFDGHILDLHSAVKDGVLGGGDGKFLVVVTDEKKKLDLKEMISELELPEIPSVFICPISLEPMQDPVTLCTGQTYERSNILKWFNIGHCTCPTTMQELWDDLVTPNKTLHQLIYTWFSQKYVLMKKRSEDVQGRAIEILGTLRKAKGKAKVHALSELKQVVMAHAIAKKTVVDEGGVFVISSLLSPFTSHAVGSEAIAILVNLELDSDSKAGLMQPARVSLMVDMLNDGSIETKINCARLIGRLVEEKGFRAELVSSHSLLVGLMRLVKDRRRRNGVSPALTLLKSVSVHKQVRNLLVRIGAVPQLVDVLPCLDVECLESALFVLDSLCLESEGRIALKDSVNTIPHTVRLLMKVSEKCTNYAISILWSVCKLASEECSSLAVEVGLAAKLLLVIQSGCDPALKQRSAELLKLCSLHYSDSMFISKCKLTRTIQ

SEQ ID NO: 230 - DNA, 3882 bp, Arabidopsis thaliana
atgcaatcggattcgggtttgcctcccaagacgtattcgggtgtcaaattcgctctcgttggattcaatcccatccatggaaactcgttacggtcgaagctagtgagtggtggtggtgttgatgttggccaattcactcagtcatgtactcacctcatcgtagataagcttctctatgatgatccgatttgcgttgctgctcgaaacagcgggaaggtagttgtcaccgggtcatgggttgatcacagcttcgacattggaatgcttgacaatgcaaattcgatattgtataggcctcttagagatttgaatgggattccagggtccaaagccttagttgtgtgcttgactggctaccaaggagaaaagtatgagctagccaagcggattaagaggattaaacttgtgaaccaccgttggttagaggactgcttaaagaattggaagctcctacctgaggttgattacgagataagtggctatgagttggacataatggaggcttcagctagggattctgaggacgaagcagaagatgcctctgtcaagcctgcaaataccagtcctcttggtcttagggttggtgccgtgcctgcagttgaaatctctaagccgggaggaaaagatttccctcttgaggaagggtcatcattatgtaatacgtccaaagataattggttaactcctaaaaggacggacagaccttttgaagcaatggtctctactgatctaggtgttgctcagcagcataattacgtgtcccccattagggttgcaaacaagactcctgagcaagggatgagcaaaatggagactgatggctcgacgtctattaacaggagtatcagaaggcattcttctctagccacttattcaaggaaaacacttcagagatcgccagagactgatactttgggaaaagagtcaagtggccaaaaccgttccttgagaatggatgacaagggcctaaaagcttcgtctgcctttaatacctctgcatcaaaatctggttcttccatggaaagaacgtcactctttcgagatcttggcaagattgatatgttgcatggcgaggagttccctccgatgatgcctcaggcaaaatttacagatggatctgtcagtaggaaagattcactgagagtacaccacaacagtgaggcaagtattccaccaccgtctagtttgttattgcaggaactaagaccaagttcgcctaacgacaaccttaggcctgtgatgagcattagtgacccaactgaaagtgaggaagctggccataaatcacccacgagtgagttaaacactaaactgttgagctctaatgtggtacccatggtcgatgctctttcaactgcggagaatatcatttcaaattgtgcgtgggatgaaataccggagaaatcattgactgagagaatgacagaaaatgtcttattgcaggaacaaagatcaggctcacctaagcaaaaccttagtgttgtgccaaacctcagggaagctgcacatgagttggatctgagtgattcagcagctaggttgttcaattcaggtgttgttcccatggaagctgatatcagaactccagaaaattctactatgaagggtgcattggatgaagtacctgaaagatctgtaactgaccctgtgatgaggagatctagcacctctcctggatcgggtttaatcagaatgaaagacaagcaagaaacagagctgaccacgaagaaaacagctccaaaaaagagcctaggcaccagaggcaggaagaagaaccccattaaccaaaagggatcaatatacttgagcgaaccttccccaacggacgagcgcaatgtttgtctaaacaaaggaaaagtttcagcgccagtaacaggtaatagcaatcaaaaagagatatcaagccctgtcctaaatactgaggttgtacaagacatggcaaaacatattgacacagagactgaagccctccagggaattgactctgtagataataaatctttagccccagaagagaaagaccatcttgtgttggatctgatggtgaaccaagataagctgcaggctaagaccccagaggcagctgatgcagaggtggaaattacggtgctagaacgggagcttaatgatgttccaactgaagatccaagtgatggtgcattacaatccgaggttgataagaatacaagtaaacgcaaaagggaggctggtgtaggtaaaaatagccttcaaagagggaagaaaggaagttcttttacagccaaagtaggaaaatccagagtcaagaagaccaaaatatctagaaaagaaaatgatatcaaagcaaatggtactctgatgaaagatggaggggataactctgcggatgggaaggagaacttagcattggaacatgaaaatgggaaggtcagttctggtggagaccaaagccttgttgcgggggaaacattaacaagaaaggaagctgccactaaagatccaagctatgctgcagcgcaattagaggttgatacaaagaaaggtaaacgcagaaagcaggccactgtagaagaaaataggcttcaaacacctagtgtcaaaaaggcgaaagtttctaaaaaagaagatggcgccaaagcaaacaatactgtgaagaaagatatatggattcactctgcagaagtgaaggagaatgtagcagtagatgaaaattgtggagatgtcagttctgatggagctcaaagcctggttgtggagaaatctttagctaaaaaggaggctgcagctaaggatccaagtaatgctgcaatgcaattagagtttgatgataataaatgtaaacacggaaaggagggtattgtagaaagaagtagccttcaaagtggaaagaaaggaagttcttctagagttgaagtagggaaatcaagtgtcaagaagactaaaaaatctgaaaaaggaagtggcaccgaagcaaccgacactgtgatgaaagatgtaggggataattctgcaaaagagaaggagaacattgcagtggataatgaatctagaaaggtgggatctggtggagaccaaagcccggtagcaagaaagaaagttgcaaagtcagctaaaacaggtacaaaggcggagaaagagtctaagcagctcagggttaatcctttggctagtagaaaagtcttccaggaccaagaacatgagccgaaattttttattgtcagtggtcctaggtcccagagaaacgaataccagcagatcattaggcgtttaaaaggaaaatgttgccgggattctcatcagtggtcttatcaagcaacacatttcattgctcctgaaatccgtaggaccgaaaagtttttcgctgctgctgcatctggaagttggattctgaagactgactatgtggctgattcaaaggaagctgggaaactattacaagaggagccttatgaatggcacagttctggtcttagtgctgatggtgcgataaacctcgagtccccaaagaaatggcggctcgtcagggagaaaacaggacacggtgctttatatggactgcgcattgttgtatacggtgactgcaccatcccttgtttggatacactaaagcgagctgtgaaagctggggatggtacgatacttgcaacggcgcctccttacacgcgtttcttgaatcaaaacacggatttcgcgttgataagccccgggatgccgcgggatgacgtctggatccaagagtttatacgccacgaaatcccgtgtgtcctctccgattacctggtggagtacgtttgtaaacccggatacgcacttgacaagcatgtgctctacaacacgaactcatgggcagaaaagtcgtttaacaagatgcagcttagagcagatttgtgtgtgtaccattaa

SEQ ID NO: 231 - protein, 1293 aa, Arabidopsis thaliana
MQSDSGLPPKTYSGVKFALVGFNPIHGNSLRSKLVSGGGVDVGQFTQSCTHLIVDKLLYDDPICVAARNSGKVVVTGSWVDHSFDIGMLDNANSILYRPLRDLNGIPGSKALVVCLTGYQGEKYELAKRIKRIKLVNHRWLEDCLKNWKLLPEVDYEISGYELDIMEASARDSEDEAEDASVKPANTSPLGLRVGAVPAVEISKPGGKDFPLEEGSSLCNTSKDNWLTPKRTDRPFEAMVSTDLGVAQQHNYVSPIRVANKTPEQGMSKMETDGSTSINRSIRRHSSLATYSRKTLQRSPETDTLGKESSGQNRSLRMDDKGLKASSAFNTSASKSGSSMERTSLFRDLGKIDMLHGEEFPPMMPQAKFTDGSVSRKDSLRVHHNSEASIPPPSSLLLQELRPSSPNDNLRPVMSISDPTESEEAGHKSPTSELNTKLLSSNVVPMVDALSTAENIISNCAWDEIPEKSLTERMTENVLLQEQRSGSPKQNLSVVPNLREAAHELDLSDSAARLFNSGVVPMEADIRTPENSTMKGALDEVPERSVTDPVMRRSSTSPGSGLIRMKDKQETELTTKKTAPKKSLGTRGRKKNPINQKGSIYLSEPSPTDERNVCLNKGKVSAPVTGNSNQKEISSPVLNTEVVQDMAKHIDTETEALQGIDSVDNKSLAPEEKDHLVLDLMVNQDKLQAKTPEAADAEVEITVLERELNDVPTEDPSDGALQSEVDKNTSKRKREAGVGKNSLQRGKKGSSFTAKVGKSRVKKTKISRKENDIKANGTLMKDGGDNSADGKENLALEHENGKVSSGGDQSLVAGETLTRKEAATKDPSYAAAQLEVDTKKGKRRKQATVEENRLQTPSVKKAKVSKKEDGAKANNTVKKDIWIHSAEVKENVAVDENCGDVSSDGAQSLVVEKSLAKKEAAAKDPSNAAMQLEFDDNKCKHGKEGIVERSSLQSGKKGSSSRVEVGKSSVKKTKKSEKGSGTEATDTVMKDVGDNSAKEKENIAVDNESRKVGSGGDQSPVARKKVAKSAKTGTKAEKESKQLRVNPLASRKVFQDQEHEPKFFIVSGPRSQRNEYQQIIRRLKGKCCRDSHQWSYQATHFIAPEIRRTEKFFAAAASGSWILKTDYVADSKEAGKLLQEEPYEWHSSGLSADGAINLESPKKWRLVREKTGHGALYGLRIVVYGDCTIPCLDTLKRAVKAGDGTILATAPPYTRFLNQNTDFALISPGMPRDDVWIQEFIRHEIPCVLSDYLVEYVCKPGYALDKHVLYNTNSWAEKSFNKMQLRADLCVYH

SEQ ID NO: 232 - DNA, 1476 bp, Arabidopsis thaliana
atgtctaacgaagactctcttccgcctttcactttgtttggtttggatgatgtcgaaaattacggtctggtcactgaagcagacaattcgttacctttagatatacacaatcaggtttttcaacttgtggagaagggaaaccaatcattcaaagagtctcgctttgaagaggctattagcagttattcaaaggccaattctattaaacctcttgaccctattgttcttggcaatagaagtgctgcttatataagatttggccaatatctgaagcagagatctgcatcaatttctgaatataaacctctgaatggttttgatatgtcgatgcttggtgaacttgctcttaaggatgctgataagctaatgagtcttcagagcagtttagtgaagtcatatattacaaaggcttgtgccctcatgttgctagaaagatatgaggtagcccgtgacactatcctctcaggtctacagattgatccctttagcggtcctctacgatccaatcttcaggaattggagaaagtgatgcctaattcgatgcgtaaaacccatggaatggctgagcggtctgatgattttgattgcactgtttgcctgaaattgctgtacgaacctgctacaactccatgtgggcatacattctgccgatcatgcctctttcagtcaatggatcgcggcaacaaatgtccactatgtcgaactgtcatttttatgactccaagaacatgcgctgtcagtgtgacactgaataacatcatagagaaaaactttccagaggagtatgctgaaaggaaatcagagcaagacactctggtccacctaggcaatgaaagtatgccccttttcgtcatggatgtgataatcccctgtcagaagttgtctcttcatatatttgaaccacgatatcgactaatggtgagaagaataatggaaggaaatcatcggatgggaatggtagctcttgattcggcgacaggttctccagtggatgttgcttgcgaagttgaaatcacagagtgtgatccactcccggatggacgttttgtcctggagctggaaagccatagaaggtgccgcattgtaaaagcttgggatcaagatggatatcgtgttgcagaggttgaatgggtgaaagatataccaccacaaagcgagcaagggaaagcagatctgcgggaactgacgaccagcgcagcatcatttgctcggtcatggctagatagagcaaaggaagcagctagacaaggagacagaagaagacttgaaatacttctaaatgttgaatctatgataccaacgcctcaagatcccgagcgcttcagtttctggcttgctacactgacagataggagaccttcagaaagattggaactacttcggcttcaggatactggagaggtacttgattatcggctagtacagattgctcgacaaatctcattgtttcaccagtccctttcttttgattgttga

SEQ ID NO: 233 - protein, 491 aa, Arabidopsis thaliana
MSNEDSLPPFTLFGLDDVENYGLVTEADNSLPLDIHNQVFQLVEKGNQSFKESRFEEAISSYSKANSIKPLDPIVLGNRSAAYIRFGQYLKQRSASISEYKPLNGFDMSMLGELALKDADKLMSLQSSLVKSYITKACALMLLERYEVARDTILSGLQIDPFSGPLRSNLQELEKVMPNSMRKTHGMAERSDDFDCTVCLKLLYEPATTPCGHTFCRSCLFQSMDRGNKCPLCRTVIFMTPRTCAVSVTLNNIIEKNFPEEYAERKSEQDTLVHLGNESMPLFVMDVIIPCQKLSLHIFEPRYRLMVRRIMEGNHRMGMVALDSATGSPVDVACEVEITECDPLPDGRFVLELESHRRCRIVKAWDQDGYRVAEVEWVKDIPPQSEQGKADLRELTTSAASFARSWLDRAKEAARQGDRRRLEILLNVESMIPTPQDPERFSFWLATLTDRRPSERLELLRLQDTGEVLDYRLVQIARQISLFHQSLSFDC

SEQ ID NO: 234 - DNA, 519 bp, Arabidopsis thaliana
atggcgaagagagagattagtagcactctgagaaatctaaagtttatgcaaaggtcttctctgaaagtagagaagaagaaggctgatgaagaagagcctaatgggagttttccttcccttaggactgttgcaaagaagtgtgtggtcataacagattgggatcctcagccaggagcattgttaggacgcatgtcttttcagtctttcaatccctctatcgagaaattacatgaagaggcaataaacggtggaaatccctcaagctctagcagtaatggaggaaaaaagtcttttagtgaaccggagagttcaaaggttgagccaagtggggaaacagatggtgacttgaaaagaaaacagtctgaggtagtctccgaggaacaaaaccgtcctaacaagtccccaaggagctttgacaaaccatcaccgagcaataaaaagggcaatggttttaagaaacccaagagcaagaaggtggactggagcgttttgaggccaccaaaacctcaaaccaaatag

SEQ ID NO: 235 - protein, 172 aa, Arabidopsis thaliana
MAKREISSTLRNLKFMQRSSLKVEKKKADEEEPNGSFPSLRTVAKKCVVITDWDPQPGALLGRMSFQSFNPSIEKLHEEAINGGNPSSSSSNGGKKSFSEPESSKVEPSGETDGDLKRKQSEVVSEEQNRPNKSPRSFDKPSPSNKKGNGFKKPKSKKVDWSVLRPPKPQTK

SEQ ID NO: 236 - DNA, 2994 bp, Arabidopsis thaliana
atgggggatgtagagttgccaaagcgtttgtttcggctaggttctgaacctgagggccgaaagaggataaacaattactttactcttaggtggattgagatcatcaaggctgctctagatcaaaaccatttgaagcagctggagggttcgcagtttggatttctgttgcaaatggggacgcatcagttttctgtaatgttcttacattacattctatctaggcagttggtgacagataagaagtatgaaatgtggtgggtgtttgcagggaagccaattcgatttgccattgatgattttgcacttgttaccgggcttaactgcagcaaatctggattcaacaaaaaggatgcaaggacaagagggaaaatgaaagcggttcagaatcctacgaggttctacaaggcattatttgggaaagagagaaagcctacttcacaatggattgttgggaagctatctatggggaagaaatacaaagacccgttgactcgatttcgcctatcgttgctgctactagttgatgggattctttgcccgacatgttcgcgaactatcatcgatcctgaccatgtagagatggtaaaagatgtagaatcctttcttaaatatccttggggtagaacttcgtttctcgcgactattcgaagcgccaagcaaagaacagccaaggagcttgcacaagataccacagctatacaagggtttcctcatgccttagttcttgtgacagtggcatgttgtccagctattatatacacggcagactcggtgtttaacattctagacccaaccattccagtcgagaagctggttcagtatgtattggggctgagtttgaacatcaatgtgcatgatgcacgaactatcgaccaaagtggcatggaccgggtaacctcactgctgaatgaagagctcctggcgaaagagatcgacttatctttctcagatgaggaggatgatgaagaagtttcgcatctgctatcattgataatggaggaacacccattcgagcataacagttggagtggtggtgttgatgctaatgatgttgaacatccatctgaagatgagttcatggctgatgactgtgtgaatcaggctaagggggatggtgacgatgagatggatgttgatggttctggtgttgctgcagaagagagggaagagtgtgcagccggagaaggtgtagacggattggatggtgaggcgaataaggatggaccggtgacagataaagatggtgtcagttttgcggatggagaagggttgcagcaggaagtcccaagagctggcgagatggaaaacaatgatagtggctctgctggacatggtcttagagaggcagtcatcaaagaggtagctgatgagtttgagaaacgtgttctcaagattcaacaatcaaacaacgatgaattgaagtcatactttgaggctgaactggttaagcagaagaaagaattggttgcaatacttactgaatcggttagggaagctgtgagtgggctaaatagacaggctggaattgttggagaatgcagcaaatgtgttgctgatgcccactctaaacaggaacaaataagagctgaccagccaggaaataagcatggagtttcccaacaggttgaacctaatattgggttaagtgaaggaagtgacaacttgccggctgcgtgcggcataaacgttggagtgtctgttccagaacgcagcaaccctaacactagaatggaggtaagagaagaagattctattcagaaaggaggaaagaaaaaatcttgttctcaaatggatgcacaatctaataggccactgaagcgagcgaaagatatggagcatgtggcgagcacaaagcttgaaaacaaagaggccgtgcatgaacccaaaacatatgtttcaccaactgagaaattggatgatgaagtagacattgtggagccgaatttttcgttgggactaacgcaagaaatcaacgataacagaagcaggttgcctccaagagggaagaagaagacattccccagcaaagtttctgtgttgcggtccagcaaccggataagggacaggccaattcaaagcaacagtatagagaatatgactagcataccggtccagccgcatcaaacagctagcagaggggctggtaaaagtcatgttagtagttctgcaaaagtggagaagcagactccaaatcaatcacctgcttttattgggccttttaaaccgttctctgtgcctagtccatcatctgtgaaaaggtttctcaaacaaatggaacggggagtctcatatgttctggctgatggcgttgtactggagaatacagaatttttgaacatttttgagggccagacactactagatgaatcaggacctgatctgttagtgaggttcatacagctgcgattagataaaaataagccgctgcgttttgatttcctaccttcaagtttcttgtcagagctaagacgccagtacaacaagtttgtaggagctgcagataagagtgctttttacttcagcactcttgcaagagtccccttcatggtgcgtccgaaatggtttgccgagattgacgtcatctactgccccatgcaggtcgagaggcagcattgggttgggcttgtcatagatttgaagaagtggggagtcacagttttagactgtaacagagacgtgttgaaagacgagcaggtggagaagtacgtagagcacataacaatcatgctaccgtacctgattcgaaagcatggagttaacgggtacatgctaacacagaggctggagccaatgactgttagtagacccaagatacagtgcagttgttcttcactagggctggttggaattgcaagtgtggtcttactagagctacactcagtgaacgcaatggagtattgtgggaaactagatgatgggaagatgcgagatgcagctaaacagtacgctatcgaaactttcaatgcattgtctccaacagaacgtggtgcttga

SEQ ID NO: 237 - protein, 997 aa, Arabidopsis thaliana
MGDVELPKRLFRLGSEPEGRKRINNYFTLRWIEIIKAALDQNHLKQLEGSQFGFLLQMGTHQFSVMFLHYILSRQLVTDKKYEMWWVFAGKPIRFAIDDFALVTGLNCSKSGFNKKDARTRGKMKAVQNPTRFYKALFGKERKPTSQWIVGKLSMGKKYKDPLTRFRLSLLLLVDGILCPTCSRTIIDPDHVEMVKDVESFLKYPWGRTSFLATIRSAKQRTAKELAQDTTAIQGFPHALVLVTVACCPAIIYTADSVFNILDPTIPVEKLVQYVLGLSLNINVHDARTIDQSGMDRVTSLLNEELLAKEIDLSFSDEEDDEEVSHLLSLIMEEHPFEHNSWSGGVDANDVEHPSEDEFMADDCVNQAKGDGDDEMDVDGSGVAAEEREECAAGEGVDGLDGEANKDGPVTDKDGVSFADGEGLQQEVPRAGEMENNDSGSAGHGLREAVIKEVADEFEKRVLKIQQSNNDELKSYFEAELVKQKKELVAILTESVREAVSGLNRQAGIVGECSKCVADAHSKQEQIRADQPGNKHGVSQQVEPNIGLSEGSDNLPAACGINVGVSVPERSNPNTRMEVREEDSIQKGGKKKSCSQMDAQSNRPLKRAKDMEHVASTKLENKEAVHEPKTYVSPTEKLDDEVDIVEPNFSLGLTQEINDNRSRLPPRGKKKTFPSKVSVLRSSNRIRDRPIQSNSIENMTSIPVQPHQTASRGAGKSHVSSSAKVEKQTPNQSPAFIGPFKPFSVPSPSSVKRFLKQMERGVSYVLADGVVLENTEFLNIFEGQTLLDESGPDLLVRFIQLRLDKNKPLRFDFLPSSFLSELRRQYNKFVGAADKSAFYFSTLARVPFMVRPKWFAEIDVIYCPMQVERQHWVGLVIDLKKWGVTVLDCNRDVLKDEQVEKYVEHITIMLPYLIRKHGVNGYMLTQRLEPMTVSRPKIQCSCSSLGLVGIASVVLLELHSVNAMEYCGKLDDGKMRDAAKQYAIETFNALSPTERGA

SEQ ID NO: 238 - DNA, 3003 bp, Arabidopsis thaliana
atgggggatgtagagttgccaaagcgtttgtttcggctaggttctgaacctgagggccgaaagaggataaacaattactttactcttaggtggattgagatcatcaaggctgctctagatcaaaaccatttgaagcagctggagggttcgcagtttggatttctgttgcaaatggggacgcatcagttttctgtaatgttcttacattacattctatctaggcagttggtgacagataagaagtatgaaatgtggtgggtgtttgcagggaagccaattcgatttgccattgatgattttgcacttgttaccgggcttaactgcagcaaatctggattcaacaaaaaggatgcaaggacaagagggaaaatgaaagcggttcagaatcctacgaggttctacaaggcattatttgggaaagagagaaagcctacttcacaatggattgttgggaagctatctatggggaagaaatacaaagacccgttgactcgatttcgcctatcgttgctgctactagttgatgggattctttgcccgacatgttcgcgaactatcatcgatcctgaccatgtagagatggtaaaagatgtagaatcctttcttaaatatccttggggtagaacttcgtttctcgcgactattcgaagcgccaagcaaagaacagccaaggagcttgcacaagataccacagctatacaagggtttcctcatgccttagttcttgtgacagtggcatgttgtccagctattatatacacggcagactcggtgtttaacattctagacccaaccattccagtcgagaagctggttcagtatgtattggggctgagtttgaacatcaatgtgcatgatgcacgaactatcgaccaaagtggcatggaccgggtaacctcactgctgaatgaagagctcctggcgaaagagatcgacttatctttctcagatgaggaggatgatgaagaagtttcgcatctgctatcattgataatggaggaacacccattcgagcataacagttggagtggtggtgttgatgctaatgatgttgaacatccatctgaagatgagttcatggctgatgactgtgtgaatcaggctaagggggatggtgacgatgagatggatgttgatggttctggtgttgctgcagaagagagggaagagtgtgcagccggagaaggtgtagacggattggatggtgaggcgaataaggatggaccggtgacagataaagatggtgtcagttttgcggatggagaagggttgcagcaggaagtcccaagagctggcgagatggaaaacaatgatagtggctctgctggacatggtcttagagaggcagtcatcaaagaggtagctgatgagtttgagaaacgtgttctcaagattcaacaatcaaacaacgatgaattgaagtcatactttgaggctgaactggttaagcagaagaaagaattggttgcaatacttactgaatcggttagggaagctgtgagtgggctaaatagacaggctggaattgttggagaatgcagcaaatgtgttgctgatgcccactctaaacaggttaagcacctcaatttgcttgttgagacttcaagtattgcactagaccaaataagagctgaccagccaggaaataagcatggagtttcccaacaggttgaacctaatattgggttaagtgaaggaagtgacaacttgccggctgcgtgcggcataaacgttggagtgtctgttccagaacgcagcaaccctaacactagaatggaggtaagagaagaagattctattcagaaaggaggaaagaaaaaatcttgttctcaaatggatgcacaatctaataggccactgaagcgagcgaaagatatggagcatgtggcgagcacaaagtatgtttcaccaactgagaaattggatgatgaagtagacattgtggagccgaatttttcgttgggactaacgcaagaaatcaacgataacagaagcaggttgcctccaagagggaagaagaagacattccccagcaaagtttctgtgttgcggtccagcaaccggataagggacaggccaattcaaagcaacagtatagagaatatgactagcataccggtccagccgcatcaaacagctagcagaggggctggtaaaagtcatgttagtagttctgcaaaagtggagaagcagactccaaatcaatcacctgcttttattgggccttttaaaccgttctctgtgcctagtccatcatctgtgaaaaggtttctcaaacaaatggaacggggagtctcatatgttctggctgatggcgttgtactggagaatacagaatttttgaacatttttgagggccagacactactagatgaatcaggacctgatctgttagtgaggttcatacagctgcgattagataaaaataagccgctgcgttttgatttcctaccttcaagtttcttgtcagagctaagacgccagtacaacaagtttgtaggagctgcagataagagtgctttttacttcagcactcttgcaagagtccccttcatggtgcgtccgaaatggtttgccgagattgacgtcatctactgccccatgcaggtcgagaggcagcattgggttgggcttgtcatagatttgaagaagtggggagtcacagttttagactgtaacagagacgtgttgaaagacgagcaggtggagaagtacgtagagcatataacaatcatgctaccgtacctgattcgaaagcatggagttaacgggtacatgctaacacagaggctggagccaatgactgttagtagacccaagatacagtgcagttgttcttcactagggctggttggaattgcaagtgtggtcttactagagctacactcagtgaacgcaatggagtattgtgggaaactagatgatgggaagatgcgagatgcagctaaacagtacgctatcgaaactttcaatgcattgtctccaacagaacgtggtgcttga

SEQ ID NO: 239 - protein, 1000 aa, Arabidopsis thaliana
MGDVELPKRLFRLGSEPEGRKRINNYFTLRWIEIIKAALDQNHLKQLEGSQFGFLLQMGTHQFSVMFLHYILSRQLVTDKKYEMWWVFAGKPIRFAIDDFALVTGLNCSKSGFNKKDARTRGKMKAVQNPTRFYKALFGKERKPTSQWIVGKLSMGKKYKDPLTRFRLSLLLLVDGILCPTCSRTIIDPDHVEMVKDVESFLKYPWGRTSFLATIRSAKQRTAKELAQDTTAIQGFPHALVLVTVACCPAIIYTADSVFNILDPTIPVEKLVQYVLGLSLNINVHDARTIDQSGMDRVTSLLNEELLAKEIDLSFSDEEDDEEVSHLLSLIMEEHPFEHNSWSGGVDANDVEHPSEDEFMADDCVNQAKGDGDDEMDVDGSGVAAEEREECAAGEGVDGLDGEANKDGPVTDKDGVSFADGEGLQQEVPRAGEMENNDSGSAGHGLREAVIKEVADEFEKRVLKIQQSNNDELKSYFEAELVKQKKELVAILTESVREAVSGLNRQAGIVGECSKCVADAHSKQVKHLNLLVETSSIALDQIRADQPGNKHGVSQQVEPNIGLSEGSDNLPAACGINVGVSVPERSNPNTRMEVREEDSIQKGGKKKSCSQMDAQSNRPLKRAKDMEHVASTKYVSPTEKLDDEVDIVEPNFSLGLTQEINDNRSRLPPRGKKKTFPSKVSVLRSSNRIRDRPIQSNSIENMTSIPVQPHQTASRGAGKSHVSSSAKVEKQTPNQSPAFIGPFKPFSVPSPSSVKRFLKQMERGVSYVLADGVVLENTEFLNIFEGQTLLDESGPDLLVRFIQLRLDKNKPLRFDFLPSSFLSELRRQYNKFVGAADKSAFYFSTLARVPFMVRPKWFAEIDVIYCPMQVERQHWVGLVIDLKKWGVTVLDCNRDVLKDEQVEKYVEHITIMLPYLIRKHGVNGYMLTQRLEPMTVSRPKIQCSCSSLGLVGIASVVLLELHSVNAMEYCGKLDDGKMRDAAKQYAIETFNALSPTERGA

SEQ ID NO: 240 - DNA, 790 bp, Arabidopsis thaliana
gtttcactgtctacaaaatcattgaagatctacccaaaaaaaaaaaaaaagagatggttctgctagagaagctttgggatgatgttgtggctggacctcagcctgaccgtggccttggccgcctccgtaagatcaccacccaacccattaatatccgagatataggagaagggagcagcagtaaggtggtgatgcataggtcgttgaccatgccggcggcagtgagccctggaactccaacgactccaaccactccgacgacgccacgtaaggataacgtgtggaggagcgtctttaatccgggaagcaacctcgccactagagccatcggctccaacatctttgataaacccacccatccaaattctccctccgtctacgactggttgtacagcggtgactcaaggagtcagcaccgttagggatggtccgatggagtgtgacatgcgggtgatgtaaatatggtgacctgatcttccgccaccttactttgttttttttatattgtttttgtgtactttatcagagtggataaagtgacggggaatgtttttcttttgtacaaaaaactgtcttcccacctaagcaatgtgtgttagtttctgttttgggctgtgttttgcaagtttttgtatttcagagttgtgtagtgtagttgcaagtggcggttggatctttcactatcttgttggattttgatgatggttgatgcttttgctttaatgttaaataaataagcatacttttgctaggtaccattgcatcagttcacatttcctagttttcttgt

SEQ ID NO: 241 - protein, 122 aa, Arabidopsis thaliana
MVLLEKLWDDVVAGPQPDRGLGRLRKITTQPINIRDIGEGSSSKVVMHRSLTMPAAVSPGTPTTPTTPTTPRKDNVWRSVFNPGSNLATRAIGSNIFDKPTHPNSPSVYDWLYSGDSRSQHR

SEQ ID NO: 242 - DNA, 1152 bp, Arabidopsis thaliana
ttagttgaaggtttggacaatagtgttgtgccatgggtcagacaagtgctgcaacagattctcaaatggtccttttccagtcacattgtgttgaaccacaaaccctaagaatgccaacatcgccaacctccctgcaacaacaacaaaaatgtcttttaagtcttttaactacaactagcagtttcttgcataacaagaatagcggattagtctaagcttaccgtttgctagctctttctccttggcctcttgcgtaggagcaaagttaagcgggttaaagattccaccagggtaaccaacttcacccttaggtaagctgtattgcttaaagatagggtcttggttcacacttcctgggttcttgatgtcttgccaccgtctgatctcaacgtaatgaaacaatatgaactcgatcacgaacaatgtcgacgacgatgcaaaatactgctctttcccagcatcgtaccactcaggaacatttatgattcctaccaacagttttgacaatgtgttaagttcttgaaagaagttataaattgttttaaggtcatgttaatggtaactcaccgatcttggtgaaaacttccggcaaaagcatcccagcgacaccgagcatagcccatcgtccgttgaccagctctgcctggacgaaccatttcaagttctctggatcctctgctagacccaacgggtcaaacccattgtcaccggcaagactgcaatatgtataagagtgagtgagtgaccattattaactaaaccggtatcaaccaagtccggtctaacctaaccaatccaaactgattagtcacggttgtgttcaaacaaattcctatacacttaaactaaaccggtatcggactgtcctaagctaaccaaatcgattaccatgttggttccggttgtgttaaaccgaaattgaatgtagtttgcaaaacattacctgccggtgagataatcaggcgatgccaaaccgggcaaccattctcctttcttagcttcaaccttgaacgacgacgttttggccgatgaaccgatcgatgtaaacgacaagtcgcggttcaacctaccggaagaaccggtgaggaatcttggctttgaagtacaaggtcggaaaatcgaggccgaggcatgagtagtgacagtagccat

SEQ ID NO: 243 - protein, 251 aa, Arabidopsis thaliana
MATVTTHASASIFRPCTSKPRFLTGSSGRLNRDLSFTSIGSSAKTSSFKVEAKKGEWLPGLASPDYLTGSLAGDNGFDPLGLAEDPENLKWFVQAELVNGRWAMLGVAGMLLPEVFTKIGIINVPEWYDAGKEQYFASSSTLFVIEFILFHYVEIRRWQDIKNPGSVNQDPIFKQYSLPKGEVGYPGGIFNPLNFAPTQEAKEKELANGRLAMLAFLGFVVQHNVTGKGPFENLLQHLSDPWHNTIVQTFN

SEQ ID NO: 244 - DNA, 1688 bp, Arabidopsis thaliana
aaattattagatataccaaaccagagaaaacaaatacataatcggagaaatacagattacagagagcgagagagatcgacggcgaagctctttacccggaaaccattgaaatcggacggtttagtgaaaatggaggatcaagttgggtttgggttccgtccgaacgacgaggagctcgttggtcactatctccgtaacaaaatcgaaggaaacactagccgcgacgttgaagtagccatcagcgaggtcaacatctgtagctacgatccttggaacttgcgcttccagtcaaagtacaaatcgagagatgctatgtggtacttcttctctcgtagagaaaacaacaaagggaatcgacagagcaggacaacggtttctggtaaatggaagcttaccggagaatctgttgaggtcaaggaccagtggggattttgtagtgagggctttcgtggtaagattggtcataaaagggttttggtgttcctcgatggaagataccctgacaaaaccaaatctgattgggttatccacgagttccactacgacctcttaccagaacatcagaggacatatgtcatctgcagacttgagtacaagggtgatgatgcggacattctatctgcttatgcaatagatcccactcccgcttttgtccccaatatgactagtagtgcaggttctgtggtcaaccaatcacgtcaacgaaattcaggatcttacaacacttactctgagtatgattcagcaaatcatggccagcagtttaatgaaaactctaacattatgcagcagcaaccacttcaaggatcattcaaccctctccttgagtatgattttgcaaatcacggcggtcagtggctgagtgactatatcgacctgcaacagcaagttccttacttggcaccttatgaaaatgagtcggagatgatttggaagcatgtgattgaagaaaattttgagtttttggtagatgaaaggacatctatgcaacagcattacagtgatcaccggcccaaaaaacctgtgtctggggttttgcctgatgatagcagtgatactgaaactggatcaatgattttcgaagacacttcgagctccactgatagtgttggtagttcagatgaaccgggccatactcgtatagatgatattccatcattgaacattattgagcctttgcacaattataaggcacaagagcaaccaaagcagcagagcaaagaaaaggtgataagttcgcagaaaagcgaatgcgagtggaaaatggctgaagactcgatcaagatacctccatccaccaacacggtgaagcagagctggattgttttggagaatgcacagtggaactatctcaagaacatgatcattggtgtcttgttgttcatctccgtcattagttggatcattcttgttggttaagaggtcaaatcggattcttgctcaaaatttgtatttcttagaatgtgtgtttttttttgtttttttttctttgctctgttttctcgctccggaaaagtttgaagttatattttattagtatgtaaagaagagaaaaagggggaaagaagagagaagaaaaatgcagaaaatcatatatatgaattggaaaaaagtatatgtaataataattagtgcatcgttttgtggtgtagtttatataaataaagtgatatatagtcttgtataag

SEQ ID NO: 245 - DNA, 1609 bp, Arabidopsis thaliana
gttttctttcttctccatcttcacttttttaagtagctagatgacaagacagacagctatctctcttttttttttacgaagaagaagatcaaaaaaaaaatgaattttaaaaagggacctttaagagagatggtgggagagagagcaatagagagagaaggaaatccacccccacaaatagaaagttagggtttattggaaaaaaagaaagagagtgtgtctctgtgtgtgattctaatagaggtgtagtacgtcgctttgctttcagtccattaaaaccattccataacctattccgcaccgacatgtctcctccccctttcctttattagcctctctctctctttttcactactccgtcttgattttataaacaaaagaaagaaagagagagagatcttcctcgggattgcaacatgttggactacgaatgggataatccttcctccatcgttctctccggagatgaaagaaacccggactctgacccgacccggtcatccttctcctttttcgaccccatctcccattacaacaacgaccaccgtcacatcaccatttctcctcccctcctctcttccttctctaaccaacaacaacagcatcacctcaccctctacggtcagaccaacagcaacaaccagtttcttcatcatcaccatcaccaccactccttgtacgggtccaccaccaccaccactccttacggcgcctccgatcccatctaccatccccactcttccgctccgccagcctccttgttctcctacgaccagacaggaccgggctcgggatccggatcttcctacaacttcctcatccccaagacagaagtggatttcacgtccaacaggatcgggctgaacctgggaggccgtacgtacttctcagcggcggacgacgacttcgtgagcaggctatacaggaggtctcgaccaggtgagtcagggatggcgaactcgctgagcacgccgcggtgccaagcagagggatgcaacgcggatctgagccacgcgaaacactaccacagaaggcacaaagtgtgcgaattccactcaaaagcatcgacggttgtagccgccggactaagccaaaggttttgccagcaatgcagcaggttccatttgctgtcggaattcgacaacgggaaacggagctgccgtaagcgacttgctgaccataaccgccgccgccgtaaatgtcaccaatcagcctccgccacccaagacaccggcaccggcaagactactccaaagtcaccgaacgattcgggtgttaaagcgtcatcgtcaccgtcgtccaacgcgccgcctacgatatcactggagtgcttccggcaaaggcagttccaaacgacagcgtcttcatccacgtcagcgtcttcgtcttcaaattcaatgtttttctccagcggatagttataagctttactcatatgatatattatgcttaaaatgagaaatcaaaggactcttcaatatcactagttaatgctagctgtctatcatctgaattagtcggtaatgtgtaacgttttatttcatgtctctcgtttcgtttgtcgttttcatattgtttttgacttagtagaggtttatttaattaacca

SEQ ID NO: 246 - DNA, 1764 bp, Arabidopsis thaliana
agcagcaagcttcttcttctgcatactggtcattgattggttaatcagagctctctcttttcttttcctatctctagagactagagaaatggctctctatctctcttcttcacgactcatcacctttctctctttcatcttgcttctctccaatggcttctcgtcctcttcctctcgccctagcatccaccatcgtcaccacctggacaaccacaattacaaagacgctctctccaagtccattctcttcttcgaaggtcaaagatccggaaagcttcctccaaaccagagaatgacttggagaagcaactctggtctctctgatggctctgctctcaacgtggatttggtgggaggatactacgatgcaggggacaatatgaagtttggattcccaatggcattcacaaccacaatgctctcatggagtttaattgagtttggtggtctcatgaaatctgagttaccaaacgcaaaagacgctattcgttgggctactgactttctcctcaaagccacttcacatcctgataccatttatgttcaggttggtgatcctaacatggaccatgcttgttgggagagaccagaagacatggacacaccaagaagtgtgtttaaagtcgacaagaacaatcctggttctgatatcgccggtgaaatcgccgccgctcttgccgctgcttcaattgttttcagaaaatgtgatccttcttactccaatcacctcctccaacgagccattacggtttttacatttgcggacaaatacagaggaccctacagtgcaggtctggccccagaagtttgtccattctactgttcttactctggatatcaggatgaattgttatggggagctgcttggttacaaaaagcaacaaataacccaacatatctcaattacatcaaagctaatggacaaatccttggagctgatgagtttgataacatgtttagttgggataataagcacgttggtgctagaatccttctctccaaggagtttctgattcagaaagtgaagtcacttgaagaatacaaagagcatgctgatagtttcatttgctctgttctacctggagcatcctcttcccaatatacaccaggtgggctattgttcaagatgggtgagagcaacatgcaatacgtgacgtctacatcgttcttgctcttgacctacgccaaatacttaacctctgctcgcaccgtcgcttattgcggtggctccgtcgtcacccctgcccgcctccgctccatcgcaaagaaacaggtggattatctacttggaggcaacccgttgaagatgtcatacatggttggttatggtctgaaatatccacgtcggattcaccaccgtggctcatctctcccctccgttgcagtccacccgaccaggatccagtgccacgacggcttctccttgtttacctctcaatctcctaatcctaacgacctagtcggtgcagtagtcggtggtccggaccagaacgatcaattccctgacgaacggtccgactacggacggtcagagccagcaacttacattaacgctccacttgttggagctttggcttatcttgctcgatcctaaggccaactttaactaagcttaaaccgcatttaattgttggtttacaatgttaattagtagtaatgattttataaatgaatggccaagattgtccgatccggctgaatgaatgttttagatgatgtggtatttgattttaattttctaataaaaaaaaaagtagcatttag

SEQ ID NO: 247 - DNA, 549 bp, Arabidopsis thaliana
atggcacagcatcagcattctcctcaaaggccaagagatcaggacaacacacggccacatgatcaatacggcatcgttttcagcgtctccggtgatgacgtggcaagaaagcaaggcgatagtttctctcaacctgacccaacggttgcgacgatgggatccgtagacacggttacgattggggaggctttggaggctacagctttgtctcttggagataagcctgtcgaccgtagagacgcagctgcgattcaagccgccgaaactagagccaccggtgagtctaagggtcgacccggtggtcttgcagtagcggctcaggcggctgctactactaatgaacagacggtgtcggaggaagacaaagtgaatatagcagatattctcacagatgcggcggagaggcttcccggagacaaggtggtgacaagtgaagatgcggaggcagtggttggagcggaacttagaagcagttcagagatgaagacaactcctggtggtgtcgcagattccatgtcggcaggggcaaggctcaatcaacaactctag

SEQ ID NO: 248 - DNA, 892 bp, Arabidopsis thaliana
tttcatctctatccatttactccacagagaaagattcagagaaaacagaagaaactatggcaactcaagccgccggaatcttcagccccgccataacaaccactacttccgccgtcaagaaactccacctcttctcatcaagccaccgtcccaagtctctctccttcaccaaaaccgccatccgcgccgagaaaacagagtcctcctctgctgccccagccgtgaaagaagctccagttggattcactcccccgcagctagacccaaacacaccatcaccaatcttcgccggaagcacaggaggtctcctccgtaaagcacaagtagaggaattttacgtgatcacatggaactcaccgaaagaacaaatctttgagatgccaacaggaggagctgcgataatgagagaaggaccgaatctattgaaactggcgaggaaagaacagtgtttggctttaggtacgaggttgaggtcaaagtacaagatcacttaccagttttacagagtgttccctaacggagaggttcaatatcttcacccgaaagatggagtttatccagagaaagcgaatccaggaagagaaggtgttggactaaacatgagatccatcggtaaaaatgttagtcccattgaggttaaattcactgggaaacaatcttatgatttgtaagattttaattcgtattttatataataatgctagacaaacaaaacaaatttaaaaagggatcacactacatgtaaaatcttgcggatgttataacaactctttgaacttttcaagcagctttgttttggttttgtcgatcgagtgataccatatcatgtggtaagtgaaattctctagtttgagaaagacaaaaaaaaagtccattacttgggacagggttt

SEQ ID NO: 249 - DNA, 2328 bp, Arabidopsis thaliana
atggaacccaaacctttctttctctgcattatctttcttctattttgttcttcttcgtcagagatcctgcagaagcagacttacattgttcagcttcatcctaatagcgaaaccgctaaaacctttgcctcaaagtttgattggcatctttcttttctccaagaagcggttttaggtgttgaagaagaagaggaagagccttcttctcgacttctctactcctatggctctgcgattgaaggatttgctgctcagttgactgaatcagaagccgagatactgagatattcacctgaagttgttgcagtgagacctgaccatgttcttcaggttcaaaccacttactcttacaagttcttgggactcgacggttttggaaactccggtgtatggtctaaatctcggtttggtcaaggcacaattatcggcgtgcttgatactggagtttggcctgaaagtcctagctttgacgataccggaatgccttcgattccacggaaatggaaagggatttgccaagaaggagaaagtttcagttcttcgagctgtaaccggaagctaatcggtgctagattcttcatcagaggacaccgtgtcgctaattcaccagaggaatcaccaaacatgcctcgtgaatacatttccgcaagagattcaacgggacacgggactcacaccgcctcaacagttggtggatcctctgtttcgatggcgaatgttcttggcaatggagctggtgtggctcgtgggatggctcctggagctcacattgcagtctataaagtctgttggttcaatggttgttacagctctgacattctagcagctatagatgtagcgattcaagataaagtcgatgttctttcgctttcccttggcggtttccctattcctttgtatgatgacacaatcgccattggaacattccgagccatggaacgcggtatatctgtaatctgtgcagctggtaacaacggtccaatcgaaagctctgttgcaaacacagctccttgggtctcaaccattggcgcaggcacgcttgatcgaagatttcccgctgtggtcagattagccaacggaaagcttctctatggagagtcattgtatccgggaaaaggtataaagaatgccgggagagaggttgaggtgatttacgtcacaggaggagataaaggaagtgagttctgtttgagagggtcacttccaagagaagaaatccgaggcaaaatggtgatttgtgatcgcggagtcaatggaagatcggagaaaggagaagcggttaaagaagctggaggagttgcaatgatcttagccaatacagagatcaaccaagaagaagattctattgacgttcatctcttaccagctacattgattggttacactgagtcagtccttctgaaggcttatgttaatgccacggtgaaaccaaaggcgcggataatttttggtggtacggtgattgggaggtcacgagcaccggaggtggctcagttttcagctcgaggaccgagtttagccaatccttcgatactaaaaccggatatgattgctccgggagtcaatatcattgcggcttggcctcaaaatctaggaccaaccggacttccttatgattcaagaagagttaacttcactgtaatgtcaggaacttcaatgtcttgtccacatgttagcggaatcactgctcttatccggtctgcatacccgaactggtctccagctgcaatcaaatccgcattgatgacaacagcggatttgtacgatcgtcaagggaaagcgataaaggatggtaacaaaccagccggtgtgtttgcgattggagcagggcatgtgaatccgcaaaaggcgataaacccgggattggtttacaacattcaaccagtggattacataacttacctctgcactcttggattcacaagatcagatattttagcaatcactcataagaacgtgagctgcaatggaatattgcggaaaaacccgggttttagtctcaattacccgtcgatagccgtgattttcaaacgtggcaagactacggagatgatcacaaggcgtgtcactaacgttgggagtcctaactcgatatactcagtgaatgtcaaggctccagaggggatcaaagttattgtcaatcctaagagacttgtgttcaaacacgtggatcagacgctgagctatagagtatggtttgtattgaagaagaaaaacagaggagggaaggtggctagctttgcacaagggcagttgacttgggtcaactctcataatctgatgcagcgagttagaagtccaatctctgtaaccttgaagactaactga

SEQ ID NO: 250 - DNA, 935 bp, Arabidopsis thaliana
atggataagtcttttctggataaaacgctcttcttcttctcttcatcctccttctggagcagagcttagagctccatcatcaaatcttatcaatggcttcctcactcgtctcatcttttcaacccaggtcagcatttttgggagatagaaatgtgttcaaggtctcaagcacaccttttgctcaagtgggttactccagtaagaccattgagtgcaaagaatcaaggataggaaagcaaccgatcgctgtaccttccaatgtaaccattgcattggaaggtcaagacttgaaagtgaagggtccattaggagagctggctttaacttacccacgcgaagttgagcttacaaaggaagaatccggtttcttaagggtcaaaaaaaccgtcgaaactagaagagccaaccaaatgcacggccttttcaggacgcttaccgataacatggttgtgggagtatcaaagggatttgagaaaaagcttatacttgtgggtgttggttatcgtgcaacagtagacggaaaggagctggtgctaaatctcgggttttcacacccggtgaagatgcagataccggatagtctgaaagtgaaagtggaagagaacacaagaatcactgtgagtggatacgacaagagcgaaatcgggcagtttgctgcaacggttaggaagtggaggccaccagagccatacaaggggaaaggagtcaagtattccgatgagatagttcggaggaaggaaggaaaagctggaaagaagaaatgatcttcatttttcattattatctacttacttatctcttcctttcaatgtttatgtgtatttgctcaaatttgtttagaaatgaagatgtttgtgttgggattcttgagtaagtttttaaaggaacccattaattgtttttgatgctctgacaaaaatttctttagtgctttg

SEQ ID NO: 251 - DNA, 1554 bp, Arabidopsis thaliana
atatgtgtctatcgttagcttctacagctcaacgaaacacacagttccgtagcagagttttagttttagcagagttggtgaaatcaatgggccaccaaaacgccgccgtttcagagaatcaaaaccatgatgacggcgctgcgtcgtcgccgggattcaagctcgtcggattttccaagttcgtaagaaagaatccaaagtctgataaattcaaggttaagcgcttccatcacatcgagttctggtgcggcgacgcaaccaacgtcgctcgtcgcttctcctggggtctggggatgagattctccgccaaatccgatctttccaccggaaacatggttcacgcctcttacctactcacctccggtgacctccgattccttttcactgctccttactctccgtctctctccgccggagagattaaaccgacaaccacagcttctatcccaagtttcgatcacggctcttgtcgttccttcttctcttcacatggtctcggtgttagagccgttgcgattgaagtagaagacgcagagtcagctttctccatcagtgtagctaatggcgctattccttcgtcgcctcctatcgtcctcaatgaagcagttacgatcgctgaggttaaactatacggcgatgttgttctccgatatgttagttacaaagcagaagataccgaaaaatccgaattcttgccagggttcgagcgtgtagaggatgcgtcgtcgttcccattggattatggtatccggcggcttgaccacgccgtgggaaacgttcctgagcttggtccggctttaacttatgtagcggggttcactggttttcaccaattcgcagagttcacagcagacgacgttggaaccgccgagagcggtttaaattcagcggtcctggctagcaatgatgaaatggttcttctaccgattaacgagccagtgcacggaacaaagaggaagagtcagattcagacgtatttggaacataacgaaggcgcagggctacaacatctggctctgatgagtgaagacatattcaggaccctgagagagatgaggaagaggagcagtattggaggattcgacttcatgccttctcctccgcctacttactaccagaatctcaagaaacgggtcggcgacgtgctcagcgatgatcagatcaaggagtgtgaggaattagggattcttgtagacagagatgatcaagggacgttgcttcaaatcttcacaaaaccactaggtgacaggccgacgatatttatagagataatccagagagtaggatgcatgatgaaagatgaggaagggaaggcttaccagagtggaggatgtggtggttttggcaaaggcaatttctctgagctcttcaagtccattgaagaatacgaaaagactcttgaagccaaacagttagtgggatgaacaagaagaagaaccaactaaaggattgtgtaattaatgtaaaactgttttatcttatcaaaacaatgttatacaacatctcatttaaaaacgagatcaatcaaaaaatacaatcttaaattcaaaacca

SEQ ID NO: 252 - DNA, 1999 bp, Arabidopsis thaliana
tgtcgagcaaccatggatttgtgttttcaaaatcccgtaaagtgtggtgatcgtttgttctccgcattgaatacctctacgtattacaagctgggtacttcgaatttagggtttaatggtccagttttagagaatcggaagaagaagaagaagctgcctcgtatggttacagtgaaatccgtttcttcaagtgtggttgctagtaccgtacaagggacgaagagagatggaggagagagtctgtacgacgccattgttatcggttctgggattggtggattagttgctgcgactcagctagctgtgaaagaagctagggttttagttcttgagaagtatttgattcctggtggcagctctggtttttacgagagagatggatatacttttgatgttggctcttctgtcatgtttggtttcagcgataaggggaacctaaacttgataactcaggcattgaaggcagttggtcgtaagatggaggttatacctgatcctaccactgtccatttccatctccccaataatctttctgttcggattcatagggaatacgatgatttcatcgctgagcttacgagcaagtttcctcacgaaaaggaagggatccttggattctatggtgactgttggaagatcttcaactcattgaactccctggaactaaagtcactagaagagcctatctacctttttggacagttctttcagaagccgcttgaatgcttgacactcgcttattacttgccccaaaatgctggggctatagctcggaagtacataaaggatcctcaattattgtctttcattgatgcagagtgtttcattgtgagcacagtcaatgctttgcagacgccaatgatcaatgcaagtatggttttatgtgacaggcactatggaggaattaactacccggttggtggagttggtgggattgccaagtctttggcagaagggcttgttgatcaaggcagtgaaatacaatacaaggctaatgtaaaaagtataatacttgatcatggaaaggcagttggtgtaaggctagcagatggaagagaatttttcgctaagacgataatttcaaatgctacaagatgggatacgtttgggaagctgttaaaaggagaaaagcttcctaaagaagaagaaaatttccagaaagtgtacgtcaaggctccatcatttctttcaattcacatgggtgttaaagcagaggttctccctccagatacagattgccatcattttgtgctcgaggacgattggaagaatctggaggagccttatggcagtattttcctcagcattccaaccattcttgattcatctttggctccagatggtcgacatatacttcacatatttacaacttcgtccattgaggattgggagggactccctccaaaagagtatgaggcgaaaaaggaagatgtggcagctagaataatccagagactagagaaaaaattgtttccagggctcagttcatctattacgttcaaggaggtgggaacaccaagaacacacagacgatttcttgcgagggataagggaacttatgggccaatgcctagaggaaccccgaaaggtttattaggcatgccattcaatacaacggctatagatggtctatactgcgtgggggatagttgttttcctggccagggagttatagctgtggctttttcaggagtgatgtgtgctcatcgggtagctgctgatattgggcttgagaagaaatcacgagtacttgatgttggccttcttggtttacttggttggctaaggacactcgcatagatccaatacattatttccttttcttctttattatgttaatttctattgttttactatttcttcatagaattttacttttctttattttcttatttcctcgtttacttttttctagttctatataaagaagaccttcttgtaagaaatacatctcataataattttcttaagaagcatagagtttttctctcttctactg

SEQ ID NO: 253 - DNA, 1025 bp, Arabidopsis thaliana
ccactttccaaaatagccgcaaacgattctcattgtgaactctgataatatctaagacgacgaaatgttggagctacgtcttgttcagggctcgttgttgaagaaggttctagaatcaatcaaagatctggtgaacgatgcgaatttcgactgctccagcactgggttctcactccaagctatggattcgagtcacgttgctctggtgtctctcttgctaagatccgaaggcttcgaacactacagatgcgacaggaatctctccatggggatgaatctcggcaacatgtcgaagatgctcaaatgcgccggaaatgatgacatcatcaccatcaaggctgatgacggcggcgacaccgttaccttcatgtttgagagccccacgcaagacaagattgctgattttgagatgaagttgatggatatagacagtgaacatctgggaatacctgatgctgagtaccactcaatcgtgaggatgccttccaatgagttttccaggatttgcaaagatctcagtagcattggtgacacagttgtgatctctgtgactaaagaaggcgtgaagttttctactgccggtgacattggaaccgctaacattgtgctcaggcagaacacaactgtagacaagccggaagatgcaattgtgatagagatgaaggagccagtgtctctctcatttgccctgaggtacatgaattccttcacaaaggcaactccattgtcagacacagtgacaatcagcttatcgtcggagttgccagtggttgtggagtataaggttgctgagatgggttacattcgttactacttggctcctaagattgaagaagaagaagacactaatccctaagaccccttttatatccacaatttctcttcattctaaaatgttgaagatttattgacaatgttggtgtttttttttggtgagattcctttgtatcccccctctagaatcagttgttttcttgacttattatgttttatgataacaaagttcagcaaaattagttgtcttg

SEQ ID NO: 254 - DNA, 1900 bp, Arabidopsis thaliana
atcgatcaaataaacttgaatcaaatctcaaacttgcaaagaaacttgaaatattttataacaatgggtgattctactggtgagccggggagctccatgcatggagtcaccggtagagaacaaagctttgctttctcggtgcaatcaccaattgtgcataccgacaagacggccaagttcgaccttccggtggacacagagcataaggcaacggttttcaagctcttctccttcgccaaacctcacatgagaacgttccatctctcgtggatctctttctccacatgttttgtctcgactttcgcagctgcaccacttgtccctatcatccgggagaatctcaacctcaccaaacaagacattggaaacgccggagttgcctctgtctctgggagtatcttctctaggctcgtgatgggagccgtgtgtgatcttttgggtccccgttacggttgtgccttccttgtgatgttgtctgccccaacggtgttctccatgagcttcgtgagtgacgcagcaggcttcataacggtgaggttcatgattggtttttgcctggcgacgtttgtgtcttgtcaatactggatgagcactatgttcaacagtcagatcattggtctggtgaatgggacagcagccggatggggaaacatgggtggcggcataacgcagttgctcatgcccattgtgtatgaaatcattaggcgctgcggttccacagccttcacggcctggaggatcgccttctttgtacccggttggttgcacatcatcatgggaatcttggtgctcaatctaggtcaagatctgccagatggaaatcgagctaccttggagaaagcgggagaagttgccaaagacaaattcggaaagattctgtggtatgccgttacaaactacaggacttggatcttcgttcttctctacggatactccatgggagttgagttgagcactgataatgttatcgccgagtacttctttgacaggtttcacttgaagctccacacagcagggctcatagcagcatgtttcggaatggccaatttctttgctcgtccagcaggaggctacgcatctgactttgcagccaagtacttcgggatgagagggaggttgtggacgttgtggatcatacagacggctggtggcctcttctgtgtgtggctcggccgcgccaacacccttgtaactgccgttgtggctatggtgctcttctctatgggggcacaagctgcttgcggagccacctttgcaattgtgccctttgtctcccggcgagctctaggcatcatctcgggtttaaccggggctggagggaactttggatcagggctcacacaactcctcttcttctcgacctcacacttcacaactgaacaagggctaacgtggatgggagtgatgatagtcgcttgcacgttacctgtgaccttagttcactttcctcaatggggaagcatgttcttgcctccttccacagatccagtgaaaggtacagaggctcattattatggttctgagtggaatgagcaggagaagcagaagaacatgcatcaaggaagcctccggtttgccgagaacgccaagtcagagggtggacgccgcgtccgctctgctgctacgccgcctgagaacacacccaacaatgtttgatcatacattccacccacggtggaatggtgaaggatgatcgcatataagaatatgtcacacagtgaaaaaaaaaaatgcaaatgttatcaatgcttgcataacattactatctatctttcatttactaaacaaaccttttgctttttgccttgaaatctttttattatatatcaaaatatatctctatgtcttgagatttgattattttgcatatatcattaatgatttgataatattggaactg

SEQ ID NO: 255 - DNA, 2549 bp, Arabidopsis thaliana
gcaatcaggaaaggatgacgagacaaaagatagagaagcaaaagtaagctgataaggtttgatacagtagaaaatactatctcttaacttcttcttcttcttcttcttcttctcctatctttgaaaatggcgatgactccggtcgcgtcatcatctccagtttcaacctgcagactctttcgctgcaatctcctccctgatctcttacctaagcctctgtttctctccctccccaaacgaaacagaattgcctcgtgccgcttcactgtacgtgcctccgcgaatgctaccgtcgaatcccctaacggtgtccctgcctccacatcagatacggatacggagacggataccacctcctatggccgacagtttttccctttggccgcagttgttggccaggaaggcataaaaactgctcttttacttggcgcggttgatcgtgaaatcggagggattgccatttcaggtcgtagaggcactgcaaaaacagtcatggcgcgagggcttcatgaaatcctccctcctattgaagttgttgtaggctcaatatcaaatgctgacccagcttgtccagatgagtgggaagatgacttagatgagcgcatagagtacaatgctgacaataccattaagactgagattgtcaaatctcctttcattcagattccactaggagttacagaagacagactcattgggtctgttgatgttgaggagtctgtgaaaagggggacaactgttttccaacctggtcttttggctgaagcccatagaggagtgttgtatgttgatgaaataaatctcttagatgagggaattagtaatttgcttctcaatgtattgacggatggtgttaatatagttgaaagagaaggaatcagctttaggcacccgtgcaaaccacttttaattgcaacctataaccctgaagaaggtgctgttcgagagcacttgctagaccgtgttgccattaatttaagtgcagacctacctatgagttttgaagatcgtgtcgcagcagttggaattgccacacagtttcaggaacgctgtaatgaggtttttagaatggtaaatgaagagacagaaacagcaaagacgcagattatattggctagagaatatttgaaagatgtcaagataagtagagagcaattgaagtatctggttttggaagctgtccgaggtggtgtccagggacaccgcgccgaattgtatgcagctcgtgtggcgaagtgtttagctgcaattgaaggacgagaaaaagtcacaatcgatgacctcagaaaggccgttgagctggtcattcttcctcgttcatcactagatgagactccacctgaacaacaaaaccaaccaccacctcctccacctcctccacaaaatagcgaatctggagaagaagaaaatgaagaagaacaagaagaagaagaagaggatgaaagcaatgaagaaaatgaaaatgagcagcaacaggaccaaatacctgaagagtttatatttgacgctgagggcggtctggtggatgagaaactcctcttctttgctcaacaagcccagaaacgtcgggggaaagctggcagggcgaagaatgtcatattctcagaagatagaggacgctacataaagccaatgcttccaaagggtccagtaaaaagattagctgtggatgcaacccttagagcagctgcaccataccagaaattgcgcagagagaaggatatctcaggaactaggaaagtctttgttgagaagacagatatgagggccaaaagaatggcaaggaaagctggagccctggttatctttgtggttgatgcaagtggcagtatggcattgaatcgtatgcaaaacgccaaaggtgctgcactcaaactactggcagagagctatactagcagggatcaggtttcgattattcctttccgaggggatgctgcggaagtgctcttgcccccttctagatcaatagcaatggcaaggaatcgtcttgagagacttccttgtggtggtggttctcctcttgcccatggtttaacaacggctgtaagagtaggacttaacgcagagaagagtggtgatgtcgggcgcataatgattgttgcgataaccgatggtcgagccaacattacactgaaaagatcaactgatccggagtctattgccccagatgctcctagacccacgtccaaagaattgaaggatgagattctggaagttgctgggaagatatacaaggcagggatgtctcttctagtgattgataccgagaacaagtttgtttcaactggttttgcaaaggagatcgcaagagttgctcaaggaaaatattattacttgccaaatgcttcggatgctgtaatctcggccaccactagggatgcactatctgatctgaagaattcttgacctcattttgtctgcaataccttgattctggatcaaagtgtatattctaattgtgcaacacatcagtcactaaacatgaaattataagaaatgaaattttgttttaacatactcttaaaatgaatttccgattttattcc

SEQ ID NO: 256 - DNA, 3891 bp, Arabidopsis thaliana
atgccaccaagaaagaagcccaagtcttcagctttgaaatcaaacaaacaatcttcagctaatcattcgtcacaaccttccacctttggcatccagcagttgttccttcgacatattcagaactcccaatcaacttccaactctcatacctccactgctgacccagttgatcaacagaatgtgaatggtcttgcctctgacactgcagttttaacgcctcaaaaccctctaggcacatcgaatgagaaacctgatgagtccaaagatatggaccagcaactcacggaggcatctcctaagatctccaaaaacctgaagcgcttctctcctggaatgctgataaagcaaagtcaagatgactgtggtggtgagataacttggaaaatctctccagtaaatgaaagacttcgggcagctgctaagaacattcctaagatgatggacttaacagaaaattcactagggaagcaatgtcctacatcaggtataacttccaaggttgagcaatggttatcttcaccctcaaaaaaagcttccaaaagaccagcttttgcaacaaatagggtcatggaaagggtaaatccttccccagatgcagagtttgaaattgttaacacttcaagtagtggaaacagtcctttccagaccccaccgtctctttcatgccctcacaacaagcttccttgtactgtaacgtgcagcggagcttgtggatctatgggggctggacaacataaaaaggccttgcttgaactattagatcaagtggaggatgtcatcgcagttgatgacaaaacaactgatgatgtggggattgtgatgcctcaagctcgagttaaagatgatatcatctcttctgttgttgattgcgctgtagatgaagggccagtttctctaccaaaaatgcagaattccataaatccagatagctatttccttgtattggaggtatcggagaaacgtggctcgggtagctcatctaagggtcaatgtccttataaggttcttcgcttgctagatgagcacacaggagtggaatgcgctttgtatctctgggatgaatggttttacagcactgtatcaccaggagattcaatcaatgttattggagagtttgatggggatggcaagtgtgacgtggaccgtcaaaacaatttcttaattgttcatcctgatacccttgttgccggaactagggttgctgcaagttttggttgcccaaggcgaaccgtgctagatgagaggctcagatccaatgaacacgctacagtagccttacttggaaccttgcaacaccaagtttttcaggctggtctctcgcaagaatctccatctgtagatggtttgcaagaatatgcaagcacagtgattgagaaaagtattgagagcttatatgcatgcggagtgcatgaaggagacgtgagatcaactttatttaaagctatcccgaaaatgttgaattggattgagcatttcagatattcgaaggactcagaagtatcaaaagttgattttggttctaccattgggaagaaagctgttaaggtatcagaggtaattgatattgaggagatgtcatgggcccctaaatatggtctcaaagggatgatcgatgcttcggtcagagtgatagttgaatctgacatgaacacagtgaatgagaagataatgccccttgagtttaaatctggaaaagctcctagtggtcagtcatcaatagagcattctgcacaggtgatcctgtacacgctccttatgtctgagaggtacctgaagcatattgacaatggccttctgtactatctacagtcagatcagacccagggaatttctgttcaacgatcagatttggtgggtctgattattcgtcgcaatgaacttgcaaatgacattcttgtggcgtcaacaacccagcaactgccgccgatgttacgggcagatggtggaaacacagagagtagcggacttggtgatgtctttgacacacatgtttctcatctatcaactttacatttcaatttcctccgacactgggacaggctaattgacttggaaggtagagagatgcagcttctacggaaagatattgcgcatccacatggttcaaagggcagccactcagctagttatctttcttcaatggttcttgacgtgacaaatgggtttcagcatcataactctcataaagaaactagattcatctatcgttttgtacgtcaaaaatcatctgaatctagagaaagagtaaccagtgaagatatgattaggactggaaaccttgcaactgatgacctggattgcaaacttagaactggagatcgtgtgattcttcgcacagaagtcagccacctgaccgttgcaaatgggattatagcagatattagtcgcacacatatatcagtttctttatccaagcgattacgtcttccttggagcgaaccttcttctgaggtatcaaatctctctcatgagttatggagaatttacaaggatgaattcatgacatcattttcggttatgaggttcaatctcatgcagcttttcgtacaaaatggacataacatcaggaaaatgattgtggatctcgagcctcctagatttgacaatggatctatactgagccaggatcctgcaatatcatatatttggtcagaaaagagtctgaataatgatcagcgccaagctatacttaagatactcactgcaaaggactatgctttgatattaggaatgcctggaacaggaaaaacctccacaatggttcatgctgtgaaagctttgttgatcagaggctcatctattctgcttgcatcgtacacaaactctgctgttgataatctacttatcaaactaaaagcacagggaattgagtttctacgtattggtagagacgaggctgtacacgaagaagttcgagaaagttgcttttcagccatgaatatgtgcagtgtcgaggacataaagaaaaagttggaccaggtcaaagttgtggcctctacatgtttgggaatcaatagtcctttgcttgtgaataggcgatttgatgtatgcattattgatgaagctggccagattgccctccctgtttcgatagggcccttgctgtttgcatctacctttgtacttgttggtgaccactatcaactaccgccactggtgcagagtacagaggctagagagaatgggatgggaataagcttgtttcgcaggttatcagaagcccatcctcaggcaatttcagtgttacaaaaccagtaccgaatgtgtcgaggtattatggaactatcaaatgccttgatatatggagacagattatgctgcggttctgctgaagtagctgatgccacacttgtgctttctacctccagttctacttcgccatggcttaaaaaggttctggagccaacaagaacagttgtatttgttaatacagatatgctgcgtgcttttgaagctagggatcagaatgcgatcaacaatccagttgaagcttccataatagctgagattgtagaggagctagttaacaatggagtggatagtaaagatattggaatcattactccttataactcacaagccagcctcattcaacatgccattccgacaactcctgtggagatacatactattgacaaatatcagggaagagataaagactgcatattggtatcttttgtgagatcgcgagagaaaccaaggagctctgcttcttcactgctcggagattggcataggatcaacgttgctttgacacgagcaaagaaaaagctgataatggtgggatcacaaagaacactctcaagagttccacttctgatgcttcttctaaacaaggttaaggagcagtcaggtatcttgaatctgttgccgggagatttaaaaccataa

SEQ ID NO: 257 - DNA, 2270 bp, Arabidopsis thaliana
gttaacacttttgtgccgaccgatgaatcaaaattagagtaacagtgaaacgcattcttccctcaatcgttcaaatgcaagatttcttcggctccgttcgtcgatcgcttgttttccgtccttcttccgacgacgataaccaggagaaccagcctccgtttcccggtgttctcgccgataagatcacctcttgcatccgcaaatcgaagatttttatcaaaccctccttctcgcctcctcctcctgctaacactgtagacatggcacctccgatttcgtggaggaaaggtcagttaattggtcgcggcgcgtttggtacggtgtacatgggtatgaatcttgactccggggagcttctcgccgtcaaacaggttctgattgcagccaattttgcttccaaggaaaagactcaggctcatattcaggagcttgaagaagaagttaagcttcttaaaaatctctcccatcctaatatagttagatatttgggtacagtgagggaagatgataccctgaatatccttctcgagtttgttcccggtggatcgatatcatcgctcttggagaaatttggaccttttcctgaatcagttgtccggacatacacaaggcaactgcttttagggttggagtacctgcacaatcatgcaattatgcacagagacattaagggggctaatatccttgtggataataaaggatgcattaagcttgctgattttggtgcatccaaacaagtagctgagttggctacgatgactggtgcaaaatctatgaaagggacaccatattggatggctccggaagttattcttcaaactggacatagcttctctgctgacatatggagcgtcggctgtacagttattgaaatggtgactgggaaggctccttggagtcagcagtataaagaggttgctgctatcttcttcataggaacaacaaaatcacatcctccaatacctgatactctctcctctgatgcaaaagattttctgctcaagtgtctgcaggaggtaccaaatctgcggccaaccgcatctgagctactaaagcatccttttgttatggggaaacacaaggagtctgcttctactgatcttggttctgtcctgaacaatcttagcactccactaccgttacagataaataacaccaagagcactccagattctacttgcgacgatgtaggtgacatgtgtaactttggcagtttgaattattcacttgtagatcctgtgaaatcaatccaaaacaaaaatttatggcaacaaaatgataatggaggtgatgaagacgatatgtgtttgatagatgatgagaatttcttgacatttgacggagaaatgagttctacccttgaaaaagattgtcatctgaagaagagctgtgatgacataagtgatatgtccattgctttgaagtccaaatttgacgaaagtcctggtaatggagagaaagagtctacaatgagcatggaatgtgaccaaccttcatactcagaggatgatgatgagctgaccgagtcaaaaattaaagctttcttagatgagaaggctgcagatctaaagaagttacagactcctctctatgaagaattctacaatagtttgatcacattctctcccagttgtatggagagtaatttaagtaacagtaaaagagaggacactgctcgtggtttcctgaaactgcctccaaaaagcaggtcaccgagtcggggccctcttggtggttcaccttcaagagcaacagacgcaactagttgttccaagagcccaggaagtggaggtagtcgtgaattgaatattaacaatggaggtgatgaagcttcacaggatggtgtatcagcacgggtcacagactggaggggtctcgttgttgacactaagcaggaattaagccagtgtgttgctttgtcagagatagagaagaagtggaaggaagagcttgatcaagaactggaaagaaagcgacaagaaatcatgcgccaagcagggttgggatcatccccaagagacagaggcatgagccgacagagagagaagtcgaggtttgcatcaccaggaaaatgacttgcacaaaaagtctccggctttttgatttttgattgctcaactagtatatatatctgtaactcttatcttgctgtgatgaaaagtagacacgaggtttggtctgaatatatgattctgaactggttgttgaaggtattagatgtgtgtaatgtgagtgtcgggtgcatatttaagtgcgctacaaattgctaa

SEQ ID NO: 258 - DNA, 1275 bp, Arabidopsis thaliana
ttttcaaaataaaaattgaaaaaaccaaaaagacacactcataaaagatttattttagagaacaaaaaaatcagaaatataaaaaactgtcttaaggaagagaaaggaacaaaagaaaacagatgtgagctcttcttcttcgtcttcttctctctattttattctcatcctctcctcacagttactataagctcgtctatggccagagacggtggtgtttcttgtttacgaaggtcggagatgatgagcgtcggtggtatcggaggaattgaatctgcgccgttggatttagatgaagttcatgtcttagccgttgatgacagtctcgttgatcgtattgtcatcgagagattgcttcgtattacttcctgcaaagttacggcggtagatagtggatggcgtgctctggaatttctagggttagataatgagaaagcttctgctgaattcgatagattgaaagttgatttgatcatcactgattactgtatgcctggaatgactggttatgagcttctcaagaagattaaggaatcgtccaatttcagagaagttccggttgtaatcatgtcgtcggagaatgtattgaccagaatcgacagatgccttgaggaaggtgctcaagatttcttattgaaaccggtgaaactcgccgacgtgaaacgtctgagaagtcatttaactaaagacgttaaactttccaacggaaacaaacggaagcttccggaagattctagttccgttaactcttcgcttcctccaccgtcacctccgttgactatctcgcctgaatcgtcgccgccgttgactgtttcgactgaatcgtcggattcgtctccgccgttatctccggtggagatcttttccacctcgccactttcatctccgatagacgatgaagatgatgacgtgttgacgtcgtcgtcggaggaatcgccgattcgacggcagaagatgaggagtcccggattagattagtggaactattctgggatgccgtgtaatattatctatctccgttaacttcgtttttacctctgacggtgtttttaattgcacgttgacttgacgccgtcaaattttatagatgtccctttaatctctcgcgcctccacgtgggccttttttccttttccttaaagcttttcgaatatcttttaattattttaatttctgcacaaagttacgtttttaacttttttagtctttaaacaaagggaaaattgcaatcgaaccttcgacattcaccatttattatgataacgagacttgaat

SEQ ID NO: 259 - DNA, 2150 bp, Arabidopsis thaliana
cttcatcttcatcatcgtctcttctcttctactccaattcgtctcttttagtctcttacactttcctaattcttcagtggttggttttcacacagcgagagtttcaagcgtctatgcgtaattaagcagctccttaatggcttcttcttccaccagctccctcaatctccactctctccccaaggcttcttctgggttgggccaatggaagagtgggttccggtacgaattgttgggtagctccgtttctaggaaccgattgtttgtttctcctgtggtgattcatcaccgaagtccgagacttccggcgatcaaagcggcgtataactcagatggaggctcgaagcgtagtagggtttataaggagtcacaagcggctagtggttttcctaatgctaaagtgcagcagattgcgtcttccgtcttgcccttgggatcatttgctgtcgtcactttcgttttgtggaaagtggttgggaagttcatgtcgcctaagtctccaaagacttctgctggagaaaacaactcttctacacagggagtgaaatggtcgatcggggccggtactaatttgttacaaggatttgctgctaaggttgatagagaggccaagcagaggcttaatgaatttgcaaaagaacttaggtccttcagaagtgttgacatgtcaggatgcaactttggagatgaaggattattctttcttgctgaaagccttgggtataatcagactgtagaggaagtcagtttttctgcaaatggaattacagctgcaggagttaaagcctttgatggtgttcttcaatcaaatattatgttaaaaattcttaatctttctggaaaccctatcggtgatgaaggagctaagactttatgcgctacactgatggaaaattctagcattgagatacttcagctgaacagtactgatataggagatgagggtgcaaaggaaatcgcagaattgttgaagagaaattcgaccttgaggattattgagctgaataataacatgattgactattctggattcacaagtcttgctggagctcttcttgagaataatacaatacgcaatttacatctcaatggaaattacggtggtgctttgggtgccaatgctttagctaaagggcttgagggtaacaagtctttacgggaacttcatttgcatggaaactctattggagacgaagggactcgtgctttgatggctggtctatcttcccacaaagggaaagtggctttgctagatctcggcaacaactccatttccgcaaagggtgccttctatgtagctgaatacatcaagagaagcaagagcttggtttggctgaacctgtacatgaatgatataggtgatgagggagctgaaaagattgcagattctctgaagcaaaaccgttcaattgcaaccattgacctgggtggaaataacatccacgcggagggagttaatgctatagctcaagctctgaaagataatgcaattattacgacgttagaggttggttataatcccataggaccagacggagctaaagcattatctgaaattctcaagttccatggaaatgtaaagacgctcaaacttggttggtgtcagatagctgccaagggtgctgaacatgttgcagacatgttgagatataacaatacaatctcggttttggacttgcgggcaaatggacttagagatgagggagcttcctgcttagctcgaagcttgaaagtagttaatgaagctctgacatctgtggatctaggattcaatgaaatacgggatgatggagcattcgccattgctcaagcattgaaggccaatgaagatgtcacagttacatcgataaaccttgggaacaacttcatcaccaagtttggacagagtgcgctcacggatgctagagatcatgttcttgagatgactgaaaaggaagtagaaattttcttctaggagagacattgaagtgaagaagactttgtcactctgtaattttgcaccattagttgttgtttcattatttatgacgttgaaatgattcaagcgagagataaaacatttgttgttccttacggtgagatttaattttaattcaaggaagttttcatgaaaaatggtgttgactaacaaaagagaggcattttaagtc

SEQ ID NO: 260 - DNA, 1770 bp, Arabidopsis thaliana
aaatcgtcgtcgtcgtcgtgtcttcttcgtcagcagagaagctccggcgatgggtttacacaaattgagactcgcagcggcggttcctgtaaccttctcctctcgcctcttcctcaagccatttaccaatactcttaccctaggtttgttttcccgccatcttcaaccccgtaataagcctctccttgtcagagctttctccgcttccgccgccgtacaagatattccggccacacagacctccgattcctctgcaaggcctctgtggaaggcagcgattgatttcaaatggataagggacaataaggaagcagtcgaaatcaacatcaggaacaggaattcgaatgctaatttggaagctgtgctccagctttatgagaacatggtcaatctccaaaaggaagttgagaggcttcgtgaggaaagaaacaacgttgccaaaaagatgaaagggaagctggagccatcagaacgtgagagactcgtagaagaaggtaaaaatcttaaggaaagtcttgttactctggaagaagacctcgtgaagcttaaagatgagctccaacatgtagcacagtctataccgaatatgactcaccctgatgttcctgttggaggagaggattcatcggcaattagacaggaggttggtagtccacgtgagtttagttttccaataaaggatcatcttcagcttgggaaggatcttgatctcattgattttgactctgctgctgaggtaagtggttcaaagtttttctatctgaagaatgaggcagttctattggagatggctcttcttaattggacattatcacaagtcatgaagaagggttatacccccctaacgactcctgaaatcgtgagatcttctattgttgagaaatgcggtttccaacctcgtggggataatactcaggtctattcgatagatggaactgaccaatgtctcattggtaccgctgaaattcccgtaggaggaatacacatggattctattcttcttgaatcagcattgcctttgaaatatatagcattctctcattgcttccgtactgaagcgggtgctgctggcgctgccacaaaaggtctttaccgagttcatcagttcagcaaagcagagatgttcgtcatatgccaacctgaagatagtgaatccttccaccaagaactcattcagatcgaagaagatttattcacttctctaggattacactttaaaacattggatatggccacagccgatttaggcgctccagcatatcgcaagtttgacattgaagcatggatgcccggtttaggacgatttggcgagatatcaagcgcatcaaactgcacagattaccaaagtcgaagactgggaatccgttaccgcccatctgaaccgcctcagacgggtcctaagaaagggaaagcgaatcttccagccactaagtttgtccacactctaaacgcgactgcgtgtgccgtcccaaggatgatggtgtgtttgctggagaattaccagcaagaagatggatctgtggtgatccctgagcccctgaggcctttcatgggaggcattgaactcatcaaacccaagcacaagtagtttttaatggttagctctttgcaattcttgctgtgattcctcttgtacttgaggttttgttcattatacttttcacaggcgctgagttttttgtgttcttgtctcagaacataccatttatagtttatatcatcataaccgatgttctttgattcaataataacgaaagggaagtatacatt

SEQ ID NO: 261 - DNA, 2069 bp, Arabidopsis thaliana
attttttgagtcggaacctgaagtattttagtccgttcgtgataaagaaaaccgagaatgtaccggtttatcttcagacccggttgtttgtccggtttggtaaaattagaacctaacctttttatccagaactggagactttggaagaactatagaagtgttgttctcttcgtatcgtcctcaatcctcatggagactattatcaggctgttttgagcaaacgctgtgataaagaggctttctttcttgctagcaagtacacacgagtgacatggcggcatcaacttcaacccgattccttgttctgctcaaagatttttctgccttcagaaagatatcatggacttgtgctgcaactaattttcaccgccaatctcgttttttatgccatgttgcgaaagaagacgggtctcttactcttgcaagccttgatttggggaacaaaccacggaaatttgggaagggtaaggcgatgaagcttgagggaagttttgttactgaaatgggtcaaggtaaggtaagagcggtaaagaacgataaaatgaaagttgtcaaggaaaaaaagccagctgagatagtgtctcctttgttttctgcaaaatcctttgaggagcttggcctcccggattccttgttagacagtttggaaagagaaggtttctctgtcccaacagatgtccaatcagcagctgtcccggcaataatcaaaggtcacgatgcagtgattcagtcttacacaggatctggcaaaacattagcttatctgcttccaatattgtccgaaattggtcctctagcagaaaaatctagaagttcgcacagtgaaaatgataagaggactgagattcaggcaatgatcgtggctccatcaagagaactcggtatgcagatagtaagagaggtagagaaactgctcggacctgttcaccgtagaatggttcagcagttggtaggaggtgcaaaccgaatgaggcaagaagaggcccttaagaaaaataaacctgcaattgttgttggcactcccgggagaattgcagagataagcaaaggtggaaaattgcacactcatgggtgtagattcttggtgctagacgaagtcgatgagcttttatcgtttaatttccgagaagatatccatcgaatactagaacatgtaggaaagagatctggggctggtcctaaaggagaagtcgatgaacgggctaaccggcagaccattctagtctctgcaactgtgccattctcggttatccgagcagctaaaagctggagtcacgagccggttcttgtccaagccaacaaagtcactcctcttgataccgttcaaccatctgcaccggtaatgagcttgactcccacaacttctgaagctgatggccagattcagactactattcagagcttacctccagctttaaaacactattactgcatctcaaagcatcaacacaaagtcgacacgttaaggagatgcgttcacgccctcgatgcccaatcggttatagctttcatgaaccactcaaggcagctcaaagatgtggtctacaaactcgaagctcgtggtatgaattcagctgagatgcacggagatctcgggaagctagggagatcaacagttctaaagaagttcaagaacggggaaatcaaggtacttgtgacaaacgagctctctgcccggggtctggatgttgcggaatgtgatctggtggtgaatcttgagcttccaactgatgcggttcactatgctcatcgagctgggagaacagggaggctgggaaggaaagggacggtggtaacagtgtgcgaggaatcacaagtgtttatagtgaagaagatggagaagcagcttggtttgcctttcttgtattgtgagtttgttgatggagagcttgttgtcactgaggaagataaagctattataaggtgaaaatctaaagatgtaattttcagatactattattactattgaaaattcagagtcttgtccctttttcttatatattgtaaacatatttttaccagacgaagaacatctaaaaccagtgtcgaatttactccagttttgaccg

SEQ ID NO: 262 - DNA, 856 bp, Arabidopsis thaliana
atcggtatcgtcttctctctggtgttttccagtaattccctgagaagtagaagtagaagcgagaaggaattcgaagaaacagatttcaacaatggcggcagttcaacagcaacaagcgatgcagaagaacactttatacgtaggaggtttagctgatgaagttaacgaatcgatccttcacgccgcgtttatacctttcggcgatatcaaagacgtgaagacgccgttggaccaagcgaatcagaagcatagatccttcggattcgttacttttcttgagagagaagacgcttctgctgctatggataatatggacggtgctgagctttatggtcgtgttctcactgttaattatgctctccctgagaaaattaagggtggtgaacagggttgggctgctcatccactttgggcagatgcagacacatggtttgagaggcagcaacaggagaaggagattctgaagatgcaagctgagaacaaggctgccatggagactgctgaggagcttcacaggaagaaattggcggaagatcgacaaggagagatggaggaagatacagataccaaaaatgatcctatggccagagcagaggctgatgctctaagtcacggcgatgcctaatgaaagtaagcgttaccggattctcttatgcaccttgtcctgtaggataacaagtatgttttcgcctgagtgtgtaacactgtcactatcacctcatagagtttttgaggttagattgtttcttgaggttgattaccatgttattgctatagttaatagatttggtagtttggtgaaacttgcttgcttagaaaagtaagagtcatgtatctaaaccggatgctcttcata

SEQ ID NO: 263 - DNA, 1148 bp, Arabidopsis thaliana
acttttgctttcttcaacctgtcgacaacactcccgaatttttctctggcagtgtgtttaaaaaccaatggcgctagttgtgatttgtgggcaaccttgtagtggtaagtcaatagctgcagtaactttagctgaaacattgaaagagtctgaaacgaaacagagtgttaggatcatcgatgaggcttcgtttcatctagaccgcaaccaaaactatgctaacatgcctgctgagaagaatctgagaggaaagcttaggtcagatgttgatagatcagtttcgacaggcgagattgttattgtagattccttgaatagtatcaaaggttacagatatgagctatggtgtatcgctcgtgctgctgggattaggtattgtgttgtttattgtgatgtagatgaagctcattgtaggcaatggaataaggaacggagtgatagaggtgaagatggatatgacgatggtatattcgaagatctggttagaagatttgagaaacctgagagaagaaaccgatgggattcacctctctttgagctatacccttctcgtgaagttatagacaaatcctctcctgtgattttagaggctgtgacttatctaaccaagactgttgactccaaaacccaagatgtgagaattctccaaccaagtattgccactcaggctgctagattttcagaagcaaattctctttacgagttggacagagcgacacaagaaatcatcaacgcgattgtggaacaacaatcactgggcgcggctataagcagagttactcttggcaatgaactacctccgattgaaatctgcagaccgattgggctaccggagctaaggaggcttcgaagaacgtttgttaaattgatgggtcaatcgagtctaagcggtccaccgttaccaactgatgcagacagtgcaaagagacgttttgtggattacttgaacagagagtttggaggtaataacgcttgaaatttgttgggtgaaaaacatcttatttcttaaaggtttggttatgtattttcttaactcaagacttgttcttcttcatcgaaattcttttttggggctaaattgatgtgttataataggcccgttataataatgcaaacatattttggggctatagtatattttcttgttc

SEQ ID NO: 264 - DNA, 724 bp, Arabidopsis thaliana
atatccttaagaaaaacaaaaacaaaaatcaaatgagctccttcaccaccaccaacactccgccaccgtatctcctccggaaaatttatcatcgccgtgtaaaccaaccgttctccgtcgtatgttgcaccggagaaccccaacaagacatcttcacccgccggagaaccttgacttcactaataacattcacggtcatcggcggtgctacgtcatcagcattagcacaggagaaatgggggacaaggtcattcataaaggagaaatattttatgccgggactatcacctgaggatgcggcggcgcgtataaaacagacggctgaaggattaagagacatgagggagatgttggaccacatgtcgtggaggtacgttatattctacataagattgaaacaggcttatctgtctcaggatctcaccaacgccatgaacatcttgccggagagtcgccggaatgattacgttcaggcggcaaacgagcttgtcgaaaacatgagtgagttggatttctatgtacggacgccaaaggtgtacgagtcctatctttactacgagaagacattgaaatcgatagacaatgttgtggagtttcttgcttaattcagttgtattgtatatatgtctttcttcattcttcacatgaaatctctggactcgttacattagatataaaattaaaagacttaataatgtatattcaagaaacatttcgtttgcgt

SEQ ID NO: 265 - DNA, 1886 bp, Arabidopsis thaliana
gtgtctccttcactttcaaagacagtctctttccccaaagagcggattcaggattcaccatctcgatctgtgtccaaagctcctatctttcttctttcttccctgaagaattttctggagcttctcagatcagaggaagatgatgcaatcctaagactctaagacttcttcaaggctgtgttttatcgtgggatttttaaacatggggaaggaaaatgctgtgtctcggccattcactcgttcccttgcctctgctttgcgcgcttcagaagtgacttctactacacagaatcaacagagagtaaacacaaaaagaccagccttggaggatacaagagccactggacccaacaagaggaagaagcgagcggttctaggggagatcacaaatgttaactccaatacagctatacttgaggccaaaaacagcaagcagataaagaaaggacgcggtcatggattggcgagtacatcccagttggcaacttctgttacttcagaagtcacagatcttcagtccaggaccgatgcaaaagttgaagttgcatcaaatacagcaggaaacctttctgtttctaaaggcacagataacacagctgataactgtattgagatatggaattctagattgcctccaagacctcttgggagatcagcttctacagctgagaaaagtgctgttattggtagttcaactgtaccggatatcccaaaatttgtagacatcgattcagatgacaaggatcctttactgtgctgcctctatgcccctgaaatccactacaatttgcgtgtttcagagcttaaacgcagaccacttccggactttatggagagaatacagaaggatgtcacccagtccatgcggggaattctggttgattggcttgtggaggtctctgaagaatacacacttgcatctgacactctctacctcacagtgtatctcatagactggttcctccatggaaactacgtgcaaagacagcaacttcaactgctcggcatcacttgcatgctaattgcctcgaagtatgaggaaatctctgctccacgcattgaggagttttgcttcattacggataacacctacacaagagatcaggtcctggaaatggagaaccaagtacttaagcattttagctttcaaatatacactcccactccaaaaacgttccttaggagatttctcagagcagctcaagcctctcgcctgagcccaagccttgaagtcgagtttctagccagctatctaacagagttgacattaatagactaccatttcttaaagtttcttccttccgttgttgctgcttcagcggtttttctcgccaagtggacaatggaccaatcaaaccacccatggaatccaacacttgagcattacacaacgtacaaagcatcggatctgaaagcatctgttcatgccttacaagatctgcagcttaacaccaaaggttgccccttgagcgctatacgcatgaagtataggcaagagaaatacaaatctgtggcggttctcacgtctccaaagctacttgacacgctattctgaaggtttcaactcctaaccgataatagttttgtcacattgatggtccaatttcgttttcattcatctgttactctttgttcataaaacagaatttccacagtcccactcatctaatacctgattagaattcggtttagcctagtttgatccgtggtttggttcttccaaacccgggaacatctaatcggtacctagagttttttttattgtaacgagaatgtacatttttctcccatcttgaggcaatgtaaacagattcggaattttcatatcagttttctgatatgaagtaggtttaagtatttatatttcaaatttcattgattgttga

SEQ ID NO: 266 - DNA, 1183 bp, Arabidopsis thaliana
agaaatctatccacgacagcctctgagatttcgtctatagattctcattatctcacattgtccctctaaatctcctctctttgattctttctgctccgaaaaacagagagagagaacaacaaccaaacactcatttctccacatcttgagagaaaaaaacagagcaagtatattagagatctcatggcgatggcggtctccggagctgtcctcagtgggcttggttcttcgttcctcaccggaggcaagagaggtgccaccgcattggcaagcggcgtaggcactggagctcagagagttggcaggaaaactcttattgtcgctgctgcggctgctcagcctaagaaatcttggatccctgccgttaaaggtggtggcaacttccttgaccctgaatggctcgatggctcgctaccaggagatttcgggttcgacccattgggtttggggaaagacccggcttttctgaaatggtacagagaggctgagctgatccatggccgatgggcgatggcagcggttcttgggatcttcgtcggccaggcctggagcggtgtggcatggtttgaagctggagcccagccagacgcgatcgctcccttctcgttcgggtcgcttcttggaacccaattgcttctcatgggttgggtggagagcaaacgatgggtcgatttcttcaacccggattctcaatcggttgagtgggcaacgccatggtcgaagaccgccgagaatttcgcgaactataccggcgatcagggataccccggtgggagattcttcgatccgttgggtctcgccgggaaaaaccgcgacggtgtttatgagccggactttgagaagctggagaggctgaaattggcagagattaagcactcgaggctcgcaatggttgccatgttgatcttttactttgaggccgggcaggggaaaacgcctctcggtgctcttggtttgtgagaaaacggcatgatgtttttgattctgtagatacaatttctcttccaaaaacctaatgtttctcttcttcaatgtgacatttgggaaaagatcatcaaaccattgctataaatgtaaaatgaaatcatgaggcttgttcgtagataactttattatcacaactcaaatgtgaaagggaatactaaacatcaatgaaagagatccacaacttcatttctttgcc

SEQ ID NO: 267 - DNA, 1627 bp, Arabidopsis thaliana
ccgagattacagagaaccccgtcccgtgtttaaaccctccggcgacaaagctcagatagagaaccgctccacccttgtcgttcgctgcagccatgtacggcggagatgaagtgtcagctattgtggttgacttgggttcgcacacttgcaaggctggttacgccggtgaagatgctcccaaggccgttttcccttccgttattggggcagtagatggtgtagaggcaatggatgtggatgttgattctacaaagactaattcgaactctgaggattcgaagaccgagtctgaaaaggaaaagagcaaacgcaagctctatgtaggatctcaagccatgagctaccgcagagatcatatggaggttttgtcacctataaaagatggcatcgtttctgactgggatttggtggacaatatatgggaacatgctttcaagagttgtctgatgattgatcctacggagcatccaatgctgctagctgagcctcctttaaacactcaacagcagagagagaaggcggcagagctaatgtttgaaaagtacaaagttccggcactgtttatggctaagaaccctgttctcacgtcttttgctactgggcgtgctacttctttggttgttgactgcggtggaggatccacaaccatttcaccggtgcatgatggttatgttcttcagaaggctgttgtatcgtctccacttggaggggaatttctcactgactgcctactgaaaagcttggagagtaaaggaattaaaataagacctagatactctttcaagaggaaggaagtacgagcaggggaattccaggttgaagatgtggatattcctgacaccacggaaagctacaaactcttctgccagaggatgatagtgggtgatatcaaggattccatttgtcgagttcctgatactccctatgacgataaatcatattcaaacatccctactacgtcgtacgagcttcctgatggccagacgctcgagattggtgctgataggttcaaagttcctgatgtgatgttcaacccgtccatagtccagacgattcctggaatggagaagtatgctgagatgattccttccgttcgtgggttaccacacatggtcatggagagcatcaacaaatgtgatgtagacatccggagagagttgtatagtagcatactgcttgctggtggcacatcgtcaatgcaacagctgaaagaacgtctcgaaaaggacttgatcgaagagtctcctcactcagctagagttaaagtgttggcaagcggtaacacaacagaaagaagattcagtgtatggataggagggagtatattggcatcactaggctcatttcaacagatgtggttctccaagtctgagtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctattttaaaaacataaaaacatgtggaagaagtttcgttgctttattagattttcgcacaa

SEQ ID NO: 268 - DNA, 807 bp, Arabidopsis thaliana
cttcttctttcattttatcacattcatttcctttgtcttcaatccaaagctttcctcttcttggaaccaatctgctctcttttttattctgagtttgacaatggcggttggtgaggtcatgaggatggagattcccgccggtggagatttgactgttactactccggagttgcatgttcttgccgtcgatgatagtattgtggatcgtaaagtcatcgagaggttgcttagaatctcttcttgtaaagtgacgactgtagagagtggaactagggctttgcagtatcttggcttagatggaggcaaaggggcttctaatcttaaggatttgaaggtgaatttgatagtgacggattactcaatgccaggactttcaggatatgatctccttaaaaagattaaggaatcttcagcattcagagaagtaccagtagtgattatgtcatctgagaacatcttacctcgtatacaagaatgtctcaaagaaggagcagaggaattcttgttgaaaccggtgaagctagcagatgtaaagcgaatcaaacaacttataatgaggaatgaagctgaggaatgcaaaatcttaagccattctaacaagagaaagcttcaagaagacagtgatacatcatcatcaagtcatgatgatacttctatcaaggactcttcatgttcaaaacgaatgaaatcagaatctgaaaaccttttttctctactttgaattatatgtatagaggccaagaccttagcaaaaccattctgttaatattcctcaagaaagacaatgtttgagagagtcatcacact

SEQ ID NO: 269 - DNA, 1833 bp, Arabidopsis thaliana
ataaagagagatagagagagagtgggaagtatcttcaaaaccgaagccattagagagaaagagagcgtggttgaatctttgggttttactaaaagatctctctttctctcctttgtttgatcaacttggatccaacgggataaaagactattagggtttaggagattcactgggtttcataagaatttatgatcaagggtcgacttaatctcgcgttggttctttgaattgactgtgaaaagataacgaagaagaagaaaatggttagatcagatgaaaatagccttggattaatcggatcaatgagtctccaagggggaggagtagtaggaaagatcaagacgacggcaacaacaggaccgacaagaagagcactaagtactattaacaagaacatcactgaagcgccgtcttacccttatgctgtcaacaagagatcagtttctgaaagagatggcatttgtaataaaccacctgtgcatcgaccagttactaggaagtttgctgctcagttagcagatcataagccacatatccgtgatgaggaaactaagaaaccagactcagtttcaagtgaagaaccagagacgattatcattgatgtggatgaaagtgataaagaaggaggtgactctaatgagccaatgtttgtacaacatactgaagcaatgctggaggagattgaacagatggagaaggagattgaaatggaagatgcagacaaagaagaagagcctgtgatcgatattgatgcctgtgataagaataatcctttggctgcggttgaatatatccatgatatgcataccttctacaagaattttgagaaacttagttgcgtgcctcctaactatatggacaatcaacaagatcttaatgagagaatgagaggaatcctcattgactggttaattgaggtgcactacaagtttgaactgatggaggaaactctttatctcacaatcaatgtcatcgacagattccttgcggttcatcaaatcgtgaggaaaaagcttcagcttgttggtgttactgctttgttgcttgcatgtaaatatgaagaagtttcagttccagtggtagatgatctcatcttgatctctgacaaagcttactctagaagagaagtgctagatatggagaagctaatggccaacaccttgcaattcaatttctctctaccaactccatatgttttcatgaaacgatttctcaaagctgcccaatctgacaagaagcttgagattttatcattctttatgatcgagctttgccttgtggagtatgagatgctagagtatcttccatctaagctggcggcctcagcaatctacactgctcagtgtacacttaagggatttgaagaatggagcaaaacctgtgagtttcacacaggctacaacgaaaaacagctactggcatgtgcgagaaagatggttgctttccatcacaaggcaggaacagggaagctcacaggagttcacagaaagtacaacacatctaagttctgtcatgctgcaagaactgaaccagctgggtttctgatttaatattaataagaatctaatatgacttaactcgagtttttctttagaacaaaaagagtgtgagagaaagagagatagtagagcaagttgcccaaaatgggagaagaatggatctttagatatcatggcaagtagcccaaaaagagtgtattcttctctttctaaggtctttagatctttcttcacttgagagagaataaaaagaatcttctgatatcatgctttcctatattcaacttgtgaatcgattcttgtatagactcaggaaaatctatgatccagtttg

SEQ ID NO: 270 - DNA, 1214 bp, Arabidopsis thaliana
ttcctctctctttccccaaattgaaaacaaaatctgagattcgcgaaggaagaagaagagttgtcttgagagattgatagagatggacaacaatggagttaaacccgctgtttccgccatggaagcctttgaaaagcttgagaaagtaggtgaagggacttatgggaaagtttacagagcaagagagaaagctactgggatgatcgttgctttgaagaagacgcgtctccatgaggatgaagaaggtgttcctcccactactcttcgcgagatctctatcttgcgtatgctcgctcgtgatcctcacatcgttaggttgatggatgttaagcaaggaataaacaaagaaggaaaaactgtactttaccttgttttcgagtatgttgatactgatctcaagaaattcatcagaagctttcgtcaagctggacagaacattccacaaaatactgtcaagtgcttgatgtaccagttatgcaaaggcatggctttttgccatggtcatggagtgttgcacagggatcttaagcctcacaatctcttgatggaccggaagacaatgacgctcaaaatagcagatcttggattagccagagccttcactctcccaatgaaaaagtatacacatgagattctaactctatggtatagagctccggaagttcttcttggagcaacccattactctactggagtggatatgtggtctgttggctgtatttttgctgaactagtgaccaagcaagcaatctttgcgggagactctgagctccaacagctcctccgtatattcaggttgttgggaacaccaaacgaagaagtttggcctggagtaagcaaactcaaggactggcatgaatacccgcaatggaaaccgttgagtctctccacagctgtgccaaacctcgacgaggctggacttgatctcttatctaaaatgctggagtacgagccagcaaaacgaatctcagcaaagaaagctatggagcatccttacttcgatgatttgcctgacaagtcctctctctgaggctctctttataaactctcaataggatattttgttctatctctgtctttgcttgtctcaagcatttatctgctatcttaggatgattgaagtttcaatattcccttttgattgggtctctattcccaattgtataaccttccaacatttttatcaatgaaagaatatatcagtttctctaata

SEQ ID NO: 271 - DNA, 936 bp, Arabidopsis thaliana
aattattttataaagaacaaaaaaaaaaaaagacggcagagaaacaatggaacgtggagctcccttctctcactatcagctaccaaaatccatctctgaattgaacttggaccagcacagcaacaacccaaccccaatgaccagctcagtcgtagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagatggaattattcttcatttttatatctgttcaaaacatgtgtttggatagatattttatttttatgtcttatcaataacatttctatataatgttgcttctttaaggaaaagtgttgtatttcaatactttatgagaaactgatttatatatgcaaatgatttaacccaaa

SEQ ID NO: 272 - DNA, 4136 bp, Arabidopsis thaliana
cacaatctcttcttctgtgtatgtattctttttttctccgatattcgtcgatctctcaaaaatatcctcaaagccaaaaaaaagcaagagtagagataaccaaccaacaaactcataggaagacatatttactttcagggtttagctgtttgattcagcttcgatttagtgtacagtgtgttgattagtataaaaaggatttaaaagaatctgggagatgtgtatagtgattgttcttgctggcgaatgttaacactacgtcgtattgattctcgattgatagtagaagaaaggtgttagttagattgttcgttcatctagttggggtttagtttcggttcctggatggctagttcatcttcatctgagagatggatcgatggtcttcagttctcttccttgttatggcctccgccacgagatcctcaacaacataaggatcaagtcgttgcttatgttgaatattttggtcaatttacatcagagcaattcccagatgacattgctgagttggtccggcatcagtatccatcaactgagaagcgacttttagacgatgtgctggcgatgtttgtccttcatcatccggagcatggtcatgcagtcattcttccaatcatttcatgtcttattgatggctcgttggtgtacagcaaggaagctcatccgtttgcctctttcatatctttagtttgcccaagtagtgagaatgactattcggagcaatgggctttggcatgtggagaaatccttcgcattttgactcattacaaccgtcccatttataaaactgagcagcaaaatggagatacagagagaaattgtctgagcaaagctacaactagtggttctccgacttcagagcctaaggctggatcaccaacacagcatgaaaggaaacctttaaggcctttgtctccatggatcagtgatatactacttgctgctcctcttggtataagaagtgactatttccgatggtgtagtggtgtaatgggtaaatatgctgctggagagctcaagccgccaaccattgcttctcgaggatctggtaaacatcctcaactgatgccttcaaccccaagatgggctgttgctaatggagctggtgtcatactgagtgtttgtgatgatgaagttgctcgatatgagactgctacgctgacagcggtcgctgtccctgcacttcttcttcctccgccaacgacatccttagatgagcatctagttgctggccttccagctcttgaaccatatgcacgtttgtttcatagatactatgccattgcaactccaagtgctacgcagagacttcttcttggactcttagaagcaccaccgtcgtgggctccagatgcacttgatgctgctgtacagcttgtggaactccttcgagctgctgaagattatgcatctggtgtaaggctacccaggaactggatgcatttgcacttcttgcgggctataggaattgctatgtctatgagggcaggtgttgctgctgatgctgcagccgctttgcttttccgcatactctcacagccggcactgctttttcctccgctaagtcaagttgagggagtagaaattcagcacgcgcctattggtggctacagttcaaattacagaaaacagatagaagttcctgcagcagaagcaaccattgaagccactgcccaaggaattgcctcaatgctttgtgctcatggtcctgaagttgagtggagaatttgcactatatgggaagctgcttatggtttgatccctttaaattcttcggcggttgatcttcccgaaatcatagttgctaccccactgcaacctcctatcttgtcatggaatttatacattccactcctcaaagtacttgaatatcttccacgggggagtccttcggaagcatgcttgatgaaaatatttgttgccactgtggaaacaatactcagtagaacttttccgcctgaatcttccagggaactaaccagaaaagctagatcgagttttaccacaagatcagcgaccaaaaatcttgctatgtctgagcttcgtgctatggtccatgctctctttttagaatcatgcgctggtgtggaattagcttcacgcctactttttgttgtgttgactgtatgtgttagccatgaagcacagtctagtggtagcaagagaccgagaagtgaatatgctagtactactgaaaatattgaggcgaatcaacctgtatctaacaatcaaactgctaaccgtaaaagtaggaatgtcaagggacagggacctgtggcagcatttgattcatacgttcttgctgctgtttgtgctcttgcctgtgaggttcagctgtatcctatgatctctggtggggggaacttttccaattctgccgtggctggaactattacaaagcctgtaaagataaatgggtcatctaaagagtatggagctgggattgactcggcaattagtcatacgcgccgaattttggcaatcctagaggcactcttttcattaaaaccatcttctgtggggactccatggagttacagttctagtgagatagttgctgcggccatggttgcagctcatatttccgaactgttcagacgttcaaaggccttgacgcatgcattgtctgggttgatgagatgtaagtgggataaggaaattcataaaagagcatcatcattatataacctcatagatgttcacagcaaagttgttgcctccattgttgacaaagctgaacccttggaagcctaccttaagaatacaccggttcagaaggattctgtgacctgtttaaactggaaacaagagaacacatgtgcaagcaccacatgctttgatacagcggtgacatccgcctcaaggactgaaatgaatccaagaggaaaccataagtatgctagacattcagatgaaggctcagggagaccctcagagaagggtatcaaagatttcctcttggatgcttctgatcttgcgaatttcctcacagctgatagactcgcagggttctattgtggtacacaaaagcttttgaggtcagtgcttgcagagaaaccggagctgtctttctccgttgtttcactgttatggcacaaactgattgctgctcctgaaatccagcccaccgcagaaagcacctctgcgcaacaaggatggagacaggttgttgatgcgctatgcaatgtcgtatctgcaacgccagcgaaagcagcagcagcagttgtccttcaggctgaaagggagttgcagccttggatcgccaaagatgatgaagaaggccaaaaaatgtggaaaatcaaccaacggatagtcaaagtgttggtggaactcatgcgcaatcatgacaggcctgagtcactggtgattctcgcaagtgcatcagatcttcttctgcgggcaactgatggaatgcttgttgatggagaagcttgtacattacctcaacttgagctacttgaagccacggcaagagcaatacagccggtgctagcttgggggccatctggactagcagtggtcgacggtttatccaatctattgaagtgtcgtctaccagcaacaatacggtgcctttcacacccaagtgcacacgtacgtgccttaagcacgtcagtactacgtgatatcatgaaccaaagctccatacccatcaaagtaactccaaaactgccaacaacagagaagaacggaatgaatagtccgtcctatcgattcttcaacgccgcctcaatagactggaaagccgatatccaaaactgtttaaactgggaagctcacagcttgctctccacaactatgcctactcagtttctcgacactgcggctcgggaactcggctgtactatatccttgtcccaataacgagcacccacttttgtttttggtaaattttagttctctagacaaaacatttggacgtagaccaagaagaatatatatatagtttgttgtatgtaatgttgtaatgatgagtgactgacgcaatcactcccaccggcgttggatttgctctcgctcggtgtcttatataactcaacctcttctctgtacattttaaatgacgaagtagctcaatctttttttttgtgcgtctggtgtttagtcttcagtggattctaaatcgtaatgta

SEQ ID NO: 273 - DNA, 1496 bp, Arabidopsis thaliana
ttttgagttttgttctcgcaaaccggtttaacccaagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggtgagtaaatacaatctgacaatgctgatcctatttccccttgcggttaatggatccatgaaattgacttaaaaagtctttcatccatcaatgtgcaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcagacaaagatctttgggttattaaatgacattaacataaatcgatcattatgtttttgcg

SEQ ID NO: 274 - DNA, 2203 bp, Arabidopsis thaliana
aaaaatcatcaaatcttctccttctctctctctctctcacacactcactagcttctctgttaaaagcttccgtcatcacatagagaacagagactgacactaactcacttcctaacggtttccacactcaaaattacacttttgccactccggcgaacaacaatatgatcacatggcacgacctctacaccgtcctcacggcggtgataccactctacgtagccatgatcctcgcttacggctcagtccggtggtggaaaatcttctcaccagaccaatgttccggcataaaccgcttcgtcgctattttcgccgtccctcttctctctttccacttcatctcctcaaacaatccttacgcaatgaatctccgattcatcgcagccgatacactccaaaaactaatcatgctcactctcctaatcatctgggctaacttcactcgctccggtagtcttgaatggagcatcacaatcttctctctttcaacacttcccaacactctcgttatgggaatacctctcttgatcgccatgtacggagaatattccggctcactcatggttcagatcgttgttcttcagtgtataatctggtacacgcttcttctctttcttttcgaatacagaggagctaagatcttgatcatggaacagtttccagagactggtgcttcgattgtatcgttcaaagttgagtccgatgttgtttctttagatggacatgattttcttgaaactgatgctcaaatcggtgacgatggtaagcttcatgttacggtgagaaaatcaaacgcttctcggagatctttttacggtggtggtggtactaatatgactcctcgtccgtctaatctcaccggagctgagatttatagtcttaacactactccaagaggatctaacttcaatcattctgatttttactctatgatggggtttcccggtggccggctttcgaactttggtccggcggatatgtactctgttcagtcctcgagaggacctactcctagaccttcgaattttgaggagagttgtgctatggcttcttcgccaagattcgggtattacccgggaggagctcccgggtcgtacccagctcctaatccggagttttctaccggtaataaaaccggtagtaaagctccaaaagagaatcatcatcatgtaggaaaatcaaatagtaatgatgctaaggagcttcatatgtttgtttggggatccaacggatcacccgtttcggaccgagctggtcttcaagttgataatggagccaatgaacaagtcggaaaatccgatcaaggcggtgcaaaagagattcgaatgttgatctctgatcatactcaaaatgctggtccgatgaacggggactatggcggggaagaagagtcggagagggtaaaggaagtgcctaacggactacacaagcttcggtgtaactccacagcagagctaaaccctaaagaagctatagaaacgggtgaaactgtaccggtaaaacatatgccaccagcgagtgtgatgactcggctgatattgataatggtgtggaggaaactcataagaaacccaaacacttactctagtctcattggtctcatttgggctcttgttgctttcaggtgggatgtggcaatgcctaaaattattcaacaatcaatctcaattctttctgatgctggtcttggtatggcaatgttcagtttggggttgttcatggcattgcaaccgaaattaattgcttgcggaaattcgacggcgacttttgcgatggcggtgagattctttactggaccagcggtaatggccgtggcagcaatggctattggattacgtggagacctattgcgtgtggccattgttcaagctgcattgcctcaagggatcgtgccgtttgtgtttgcaaaagagtataatgttcatcccgcaatcttgagtacaggggtaatatttggaatgcttatcgcactaccgattacacttgtttactacattttactcgggctataagctcttcaatggagaagttctgcttggctgaagaggataaagagaaacaagataattccaagattagtggaacgcaactagaaaatgtaatgtaacacgaaatgtagtaaatttaaagggaccaagatttgatttgaggatccaaaaacccttttcttgtctatatattttctagagattatttgagaaag

SEQ ID NO: 275 - DNA, 1140 bp, Arabidopsis thaliana
atttcaagtaatgaagctgacatgtttatatgtactttgagagaagtgttgtgagatttgtacaaatgtatatgtacactttaaaaagcaatataagatagataaaaaaaatataaagaaaaaaagaaagaaagaaagaaagaaagagagaggctcatatatatatagaattgcttgcaaggaaagagagagagagagattgagatatcttttgggagaggagaaagaaaaagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttgaatctttctcacttaatcaatccctctcttttttttttgacatttttaagatgatgtttctattttattacctctctcatgttttctgtcttgtgtgcatgtgtgtgtgtaatgtttatgcccttctattattcaataattttttcgac

SEQ ID NO: 276 - DNA, 2457 bp, Arabidopsis thaliana
gtcctgcgcggcgtctccgtcgtctctgtcgccgcatctccgtcatcattttcgctaccgcataatctctgtctccgccgtcactgccgcagcctagaatatgatttctcgtttctgaaacccttgtataaggtagaaagagagagaaatcatccaaagcaaggaccttccagcgactttcagggtttaaggtttagcttctcgactatggcgattctagggcttatcaagagggttacacgaataaccgtaaacaattcgagggtcagagtgtacccagtgaggtacttccaaaggaaggacctttcaagcacaaatctattcaatggtgaagatgctgctaagcttcctgttctgatcgtcggcgctggaccggtgggactcgttttatccatccttctcaccaaactaggagtgaaatgtgctgttgttgacaaagccacaagcttctcgaaacatccacaagcacactttatcaacaaccgatcaatggagatcttccgtgaattggatggattagctgaggagattgaaagatcacagcctcctgtagatttgtggagaaaatttatttactgtacatctctctccggctcaacactaggcacagttgatcacatgcagcctcaagattttgagaaagttgtcagcccggcttctgttgctcacttctcccagtacaaattgacaaatttattgcttaagcggttggaagacctcggctttcatgttcgtggttccaaagagtcggatggtcttgaggctgactctgtggttgcgaggcaaattcttatgggtcatgagtgtgtggggattgatgctaacaaggacagtattactgcaactgtttcttttctcaaaggaggcaagcatatgaaaagaaacattcaatgtagtctactggttggtgctgatggtgctgggagtgcagtaagaaagctcacagtaatagaaatgcgaggggaaagagatctacagaagcttgttagtgtccatttcatgagtagagagctcggtgagtacctgatcagtaacagaccagggatgctattttttatttttaacaccgatggtataggagttcttgttgcccatgatcttctacaaggagaatttgttttgcagattccatactatccacctcaacagagtctatctgattttagtcctgagatgtgcaagatgctgatattcaatttggtgggacatgagctttcagacttggatgtagctgatattaagccatgggtcatgcatgctgaagtcgccgagaaattcatgtgttgtgagaacagagtgatacttgctggtgatgctgctcaccggttcccgcctgctggaggttttggaatgaacactggaattcaggatgctcataatcttgcatggaaaatagcagctcttgttcagggttctgcaaactcttcaattcttaaaacttatgaaacagaacgtaggccgattgccctttccaatacttcactcagtgttcaaaacttcagagcagctatgtcagttccttcagcgctaggccttgacccaacagttgcaaactcagtgcataggtttataaacaaaacagttggttcgatccttccaactgggctgcaaaaggcaatcttggataatgtctttgcactaggtcgtgcacagctttcagaatctctgttgaatgagagcaatccactgggaaatcagagacttagcagactaaagagtatcttcgaaggaggaaaaagccttcaactacagtttcctgcagaagatcttggtttcaggtatttagagggagccattgttcctgataacgagtctgaagctggtgatcccgaagtaccgagtggtcgtagaagagactatgtcccttgtgctgaaccaggttcaagactgcctcatatgtatgtgaaaatactgtcagattccacaagagaggttattgtttctacactggatcttgtttcgacagagaaagtggagtttctacttataatatcgccattacaagagtcctatgagctagctcatgctacattcaaagtcgcaaaagagtttatggctagtgtaaaagtatgcgtggtctggcctagtagtgatgatggtcttgaaaggaagagcaattcagcattagctccatgggaaaattatgtcgatgttatggaagttaaaaaacaaaatggtgaaggaacttcgtggtggagtatttgtaaaatgtcagagagaggatctattttagtccgtcccgaccaacacattgcttggcgagcaaagtctggtattactttggatcctactctgcacatgagagatgtcttcaccatcatactagggaaacaatgatgaacatcacaattttattccacaaattcctttgtatactacttattttcaaataaaatcacgttatttttgtaatggtgtttcacgatttctttacatatggtaatggtaatgttaaac

SEQ ID NO: 277 - DNA, 1906 bp, Arabidopsis thaliana
tccacttcccagttattccgggacgagattttattatctctcaaaatctttttcttttctccacccaaatataaaatcaataaaaaagataaaaactttaatttcatacctaagcaaacagtatttcgactcgagttttgagaatatccttactttgaaatatcaattttactttttgttagcgccgagagagacttgtctagggtttattctcagattctgcttctcctttgctctgatcttttcttcatcgagctctaatggctgggcgatcatggctgatcgatagcaaccggattgcaacgaagattatgagtgcatcggctagttccgatcctcgccaagtggtgtggaagagcaacccgtcaagacattgtcccaagtgtcaacatgtcattgacaacagtgatgttgttgatgattggccaggattgcctcgaggtgtgaaatttgatccatctgatcctgagatcatatggcatttgctagccaaatctggtttgtcagggttaagctcacaccctttcattgatgagttcatcccaaccgtcaatcaagatgatggaatctgttacactcatcctaagaatttaccaggtgttaagagtgatgggacggtgtctcacttcttccataaagcaatcaaagcttatagcacaggaactcgaaagcgtagaaagattcacgacgatgattttggcgatgtgcgctggcataagacaggaagaacgaaaccggttgtgttggatggtgttcaaagaggttgcaagaagataatggttctctatggcggaaaagctgtgaaaaccaactgggtgatgcaccaataccatttgggaatagaagaagacgagaaggaaggtgattatgttgtttctaagattttctaccagcagccacaacagctagtagtcaagcgaggtgataaagctgaacaggaagtctctgaggatatctttgctgcagtgactccaacagcggatcctgtcactccaaaattagctacacctgagcctcgaaatgctgtgcgaatttgctctgattctcacattgccagtgactatgttactcccagtgactatgtatctgcccatgaggtttctcttgccgagacatccgaggtaatgtgtatggaagatgaggttcagagtattcaacctaatcatgaaagaccaagttctgggcctgagctggagcacggacttgaaaacggagcaaaagaaatgttagatgataaagaggagcaagagaaggatagagacaatgaaaaccaaggtgaggaagatccgacgtggtttgacagtggatctcagtttatcttgaattcgcaacagcttgtggaagccttgtctctttgcgacgatctcttgggatcacaggacagggaggaaaacacaaacagtggaagcttaaaggataaacaaccatgtattgcggattacgcacacctaggaccagaagacttcaaacgtgatctggaggaatgtcagaaaatcgttcttgatccctctaacatagagcttgatactccacctgagtttcgtctgagccagctggaatttggatcacaggacagctttctcgcttgggggactggaaagactgattgactaaacaaaactaccacgagcttaagaccttggaactcattgattctttttggttggcaacacactgccacgctgctgtaatatggtagtttcctttgcgcatcaagggcttgattcaaactgtttttttggttttttgttttgggatttagaagaactacttttggaacgtgtttctgatcttagatgcaatgtccgtatgtaaatatgatgcttttgatgggttttattagtccaaaaatgtggaatctggatgtatggattatattcagaatttcactatgaaactttcttac

SEQ ID NO: 278 - DNA, 1038 bp, Arabidopsis thaliana
acattaccatcattagaaaactttcctaattagatcaagatcgtcgttatctctcttgttttttcttcatataatttagttattttaagagaaatgggaaggggtagggttgaattgaagaggatagagaacaagatcaatagacaagtgacattctcgaaaagaagaactggtcttttgaagaaagctcaggagatctctgttctttgtgatgccgaggtttcccttattgtcttctcccataagggcaaattgttcgagtactcctctgaatcttgcatggagaaggtactagaacgctacgagaggtattcttacgccgagagacagctgattgcacctgactctcacgttaatgcacagacgaactggtcaatggagtatagcaggcttaaggccaagattgagcttttggagagaaaccaaaggcattatctgggagaagagttggaaccaatgagcctcaaggatctccaaaatctggagcagcagcttgagactgctcttaagcacattcgctccagaaaaaatcaactcatgaatgagtccctcaaccacctccaaagaaaggagaaggagatacaggaggaaaacagcatgcttaccaaacagataaaggagagggaaaacatcctaaggacaaaacaaacccaatgtgagcagctgaaccgcagcgtcgacgatgtaccacagccacaaccatttcaacacccccatctttacatgatcgctcatcagacttctcctttcctaaatatgggtggtttgtaccaagaagaagaccaaacggcgatgaggaggaacaatctggatctgactcttgaacccatttacaattaccttggctgttacgccgcttgaatagactacatcgatctatatcaatctctttaaaataatataagatcgatcctctactcatgatctatattaaacaccggttaattaatatatttttggtatgtccttatatcatatcaacatgatcaagcctttttccaattcaatatatcttgtatttcggggagcaatgaataa

SEQ ID NO: 279 - DNA, 1638 bp, Arabidopsis thaliana
gaccctctctcgtctcatttcatcgacgggagaaaatccgatatcatctgagatttccaacagtgtcaaattgagatgtctacaggaatatcctctgatctccacctccatcctagagctctgaatttctccaaaacctccaaatctggtttaagcaatcgaaaggtgtctttttcaagtgtcgggtatgctcagaacaggaaattgagctgcagtgtttccagcacagagaatgtagctcctaaggatgatgacagaggaaaggatagacctttggttaagatgtgtggcatcacatcagccagagatgcagctatggcagttgaggctggtgctgatttcattgggatgattatttggccacattcaaaacgatccatttctctttctgttgcaaaggatatttcccaagtggccagggaaggtggggccaaacctgttggtgtttttgttgaagatgatgagaacacgatactcagagcagctgattcctctgaccttgagcttgtgcagcttcatggtaatagttcacgtgctgctttctcgaggttagtacgggaaaggaaagtcatatatgtccttaatgcaaatgaggatggaaagctcctgaatgtagttcctgaagaggatggtcatctcgctgattggattcttgtggatagtgcaacgggtgggaggtacctagatcaacttttaagtttcttcgcactgtctcattgtaatgtattccttcgaggaacgagttacacaatcactctagtccatgaaaccgtttgtctttcacaagtgactgaaatatcaagagtgtgataggttcaatcataacaattttctgctgtggaaaaggatttaactgggctcaattcaagttaccttccgtcagaagcagaaatgggtggctcttagctgggggaatcaatccaacaaatgtttcagaagctctttctatccttcaacctgatggaattgatgttagcagtggtatttgcggcatagacggcatccagaaggataagtctaagataagttccttcataactgcagttcgatctgtacactactaatggcttgcaatataagccaaggtaatttgtcttgtaactatagtttcgagcatcaaaataatgcactctcttttcatcagtaataaaggtttaaattaaaatgttgggttgcttcatcagtccaaacctagtccacacagacgagcgagaggcagctgcttttggcccttccttgaagccagagtccaatgagacaatagacacaacacctttcaaacccgtggttgagaatttttacatgacaaactcaatcacaagagcctcaaagatcatggctcagtgcagtgctttgctcctcaagaagtgatctctgtttcctaatatctgtctccgttgctgtcttcctctctcttgcaaaataaaggtgcagattctgagtttgctcgcatctttactggtcgcgtgtatcactgaattttgatttagctcgtgtagaatctgtaagtagtttacacaataaacacatgtaaggcaatttggaagaaatgtctgctgtttaaactctgcatccgtcaattggatgcttgtgacattgtttgtgtgtatgtgttcttactaggaagttttatattct

SEQ ID NO: 280 - DNA, 3021 bp, Arabidopsis thaliana
atggcggtgacgatttcgacgaatgctttcgtaaatgcatcgcttttagatgaaagtcggaattctttctggagaccattgtttcatcagccatactataattgccgacgagtcgttcgtcttaattcgaggaaattgaattcaaaggtaatgttttgcttgaatttgaacacgaaggaggttggtttgcaaaaacccggtgataaaggttttgaattcaaacccagttttgatcagtacctgcaaatcatggaatcggttaaaacagcaaggaagaagaagaaattcgacagattgaaagttgaggaagatgatggtggaggtgggaatggtgatagtgtttatgaagtgaaagatatgaagattaagagtggtgagctaaaagatgaaactttcaggaagagatactcaaggcaggagattgtaagtgataaacgtaatgagagagttttcaagaggaatggagaaattgaaaatcatagagtggctacagatttgaaatggagtaagagtggtgaatcttcagtggctctgaaattgagtaagagtggtgaatcttcagtgactgtgcctgaagatgagagtttcaggaaaaggtactctaagcaggagtatcaccgttcctctgatacatcgagagggattgaaagaggttcgagaggtgatgaattggatcttgttgttgaagaaaggagagttcagagaatagccaaagatgcaagatggagtaaaagtcgtgaatcttcagtggctgtgaaatggagtaatagtggtgaatcttcagtgactatgcctaaagatgagagctttaggagaagatactctaagcaggagcatcaccgttcctctgatacatccagagggattgcaagaggttcaaaaggtgatgaattggagcttgttgttgaagaaaggagagttcagagaatagccaaagatgtaagatggagtaagagtgatgaatctttagtgcctgtgtcagaagatgagagtttcaggagagggaatccgaagcaggagatggtgaggtatcagcgtgtctctgatacatcgagagggattgagagaggttccaaaggagatggattggatcttcttgctgaagaaaggcggattgagagattagccaatgagaggcatgagataagaagtagcaaattgagtggaaccaggagaattggtgctaagagaaatgatgatgatgatgatagcttgtttgccatggaaactcctgcctttaggttttctgatgagtccagtgacatagtggacaagccagctacttcacgagtcgaaatggaagacagaatcgagaagttagcaaaagtgttgaatggtgcagacatcaatatgcctgagtggcagttttccaaggcgatcaggagtgcaaaaatcagatatacggattacacagtaatgagactgatccactttctagggaaactaggaaactggagacgagttcttcaagtcattgagtggcttcaaaggcaagaccgttacaaatctaacaagataagaatcatctatacaactgcactaaatgttcttggtaaatcaaggaggcctgtggaagctctcaatgtattccacgctatgctgttacaaatttcatcatatccggatatggtagcataccgttcaattgcagtcacacttggacaagctgggcatatcaaggaactcttctatgtgattgacacaatgaggtctccacctaaaaagaagttcaagccaacaacacttgaaaaatgggatccccggcttgaaccagatgttgttgtttacaatgcggtgctcaacgcatgtgttcaacgaaagcaatgggaaggagcattctgggtattgcaacagttgaagcaacgagggcaaaaaccttctcctgtaacctatggcctcatcatggaggtaatgttagcatgtgagaagtacaatttagttcatgaattcttcaggaagatgcagaaatcttctatccctaatgctctagcatatagagttcttgttaatactctatggaaagaaggtaaaagcgacgaggccgtacatacggttgaggatatggaaagccgtggtattgttggatcagctgctctttactacgaccttgctcgctgtctatgtagcgcaggaaggtgtaatgaagggctcaatatggtaaattttgtaaatcctgtagtccttaagcttatcgagaatttgatttacaaagctgatcttgttcataccatccaatttcagcttaagaagatatgtagagttgcaaataaacctctcgtggtgacttacactggcctgatccaagcatgcgtcgactcgggaaacatcaagaatgcagcttacatcttcgatcagatgaagaaggtctgcagccctaacctagtcacttgcaacataatgctaaaagcttatctacaaggcggattgtttgaagaagcaagggaacttttccagaagatgtcagaagacggaaatcatataaaaaacagctcggatttcgaatcaagagtattgccagacacgtacacgttcaacacgatgctagacacgtgtgctgaacaagaaaagtgggatgattttggttatgcgtatcgggagatgttgcgtcatggataccatttcaatgcgaaacgccatctcagaatggtacttgaagctagcagagcaggaaaggaggaggtgatggaagcgacatgggaacacatgagacgaagtaatagaattccgccatcgcctctaatcaaagaaagattcttcaggaaactcgagaaaggcgatcatatttcggctatatcatctcttgctgatcttaatggaaaaattgaggagactgagttacgagcattttcaacttccgcatggtccagagtcttgtcccgatttgagcaagattcagttttgaggttaatggacgatgtgaacagacgcctaggttcgagaagtgagtcttcggattcggttttggggaatctattgagttcttgtaaagattatctgaagaccagaacacataacttgtaa

SEQ ID NO: 281 - DNA, 1578 bp, Arabidopsis thaliana
gtcacacacacataaacactccacacgctctgcttcgtccaatcaccaaacacgctttaatgactctcacgttttcctcctccgccgcaaccgttgccgttgctgctgcaaccgtaacctcctccgctagggttccggtttatccactcgcttcgtcgactcttcgtggattagtatctttcagattaaccgcgaagaagctgtttctgccgcctcttcgttctcgcggcggcgttagtgtgagagccatgtctgagcttgttcaggataaagaatcgtccgtcgcggcgagcattgctttcaatgaagccgccggtgagacgccgagtgagcttagtcattcccgtactttcttggatgcgcgaagtgaacaagatcttttatctggtatcaagaaggaagctgaagctggaaggttgccagcaaatgttgcagcaggaatggaagaattgtattggaactacaaaaatgcagttttaagtagtggagcttccagggcagatgaaactgttgtatcaaacatgtctgttgcttttgatcgcatgcttcttggtgtggaggatccttatacttttaatccatatcataaagcagtcagagaaccatttgactactacatgtttgtccatacatacatccgtcctcttattgatttcaaaaattcgtacgttggaaatgcttctatattctctgagctggaagacaagattcgacagggacacaatatcgtgttgatatcaaaccatcaaagtgaagctgatccggctgtcatttctctattgcttgaagcacaatctcctttcataggagagaacattaaatgtgtggctggtgatcgagtcatcactgatcctctttgtaagccgttcagtatgggaaggaacctcatatgtgtttactcgaaaaagcacatgaatgatgatcctgagcttgttgacatgaaaagaaaagcaaacacacgaagcttaaaggagatggctacaatgctaaggtctggcggtcaacttatatggattgcaccaagcggtggaagggaccgcccgaatccttctactggggaatggtttcctgcaccctttgatgcttcttcggtagacaacatgagaagactggttgaacattctggcgctcctggacatatatatccaatgtctttgctttgctatgacatcatgccccctccaccccaggttgagaaagaaatcggagagaaaagattagttgggtttcacggtactggactatcaattgctcctgaaatcaacttctcagacgtcacagcagactgcgagagccctaatgaggcgaaagaagcatacagccaagctttgtacaagtcggtgaatgaacaatacgagatcttaaactctgcgattaaacacagaagaggagtagaagcatcaacttcaagggtctctttgtcacaaccttggaattagtctctcgttttagggtaacactttcaaaactcataaatcttctgtctcagaagttttgttgcaactgtatatatattgagagagagagcattgttctttcatttgcaggatacacaaacacaatcaatggaaaatactc

SEQ ID NO: 282 - DNA, 2163 bp, Arabidopsis thaliana
caaaggtctgtctcttcaggttttgtttatgaaccaaataaaaaacaaaactttaccggagatgacgacggagcaagctttgttgtctatggaagctttacctttaggtttcagattcagaccaacggatgaagaactcatcaatcattacctaaggttaaaaatcaacggccgtgatttagaggttagagtcatccctgagatcgatgtttgcaagtgggaaccatgggacttacctgggctatcggtgataaagacagatgatcaagaatggttctttttttgtcctcgtgatcgaaagtatccgagtggtcatcgttctaatagagctactgatattggttactggaaagctactgggaaagatcgaactattaagtctaagaagatgattattggtatgaagaagactcttgttttctatcgtggaagagctcctagaggagagcgtactaattggattatgcatgagtatcgtgctacagacaaggaactagatggtactggacctggtcagaatccgtatgttttgtgtcgcttgttccacaagcctagtgatagttgtgatcctgcacactgtgaggaaatagagaaagttaattttactccaaccaccaccactagatgctctcctgatgacacatcttctgaaatggtccaagaaacagctacatctggtgtacatgctctagatagatcagatgacactgagaggtgtttaagtgacaagggcaataatgatgtgaaacctgatgtttcagtgataaacaatacttctgtcaatcacgctgaaacttctcgtgccaaagaccgtaatttgggcaagacgttagtagaggaaaatccacttctaagggacgttccaactcttcatggacccatcttgagtgagaaatcatattatccaggacagtcaagcatcggttttgctacatctcacatggattctatgtattctagtgattttggaaactgtgattatgggctacattttcaagatggtgcctctgaacaagatgcatctttaacagatgtcttggatgaagtattccataaccataatgaatcctctaatgacaggaaagactttgtacttccgaatatgatgcattggcctggtaatacaagactgttgtctactgagtacccatttctcaaagattctgttgcttttgttgacggcagtgctgaagtttccggctcacagcaatttgttcctgacattttagcttctagatgggtcagtgaacagaacgttgatagcaaggaggcagtagagattctatcttcaaccgggtcctctcggaccttgacgccacttcataacaacgtttttgggcaatatgcttcatcgtcttacgcagctatcgatccatttaactataatgtcaatcagcctgaacagtcatcctttgagcaaagccatgttgaccgcaacattagtcccagtaacatttttgagttcaaggctaggtctcgagagaatcagagagatctggactctgttgtggaccaaggcactgctcctagaagaattcggctgcagatcgaacagccattgacgccagttaccaacaagaaagagagagatgcggacaactatgaagaagaagatgaagtacaatctgccatgtccaaggtcgtagaggaagaaccggctaatttaagtgctcaggggactgctcagaggagaatccgcctgcagacgagattgaggaagcctctcataaccctaaacaatacaaaaagaaactcaaatggcagagaaggagaagcaagccataggaagtgtgaaatgcaggaaaaagaagatatatcatcatcatcatcatggcagaaacagaagaagagcttggtgcagtttagtagtgtggtgataatagtggcggtgatagttgttttagtagaaatatggaaagagtcaagagatgcgaaatgtagcttcttgtttcatcaattagattccttcaaaggcatgtttacttgatgatatattgtgccattctccatgtttttcgtttgtataatcaatcgcgttttagtctgtattttttctcttgtagtgttgagtaatgaagccaaattctctagaatcattaacaagtagctttcttttccattttttgcagttctaagttcaaactacttctacgtgtgtgaccg

SEQ ID NO: 283 - DNA, 924 bp, Arabidopsis thaliana
atgagttcgtctaacggaggtgtaccgcctggttttcggtttcatccaacggacgaagaacttcttcattactacttgaagaagaagatttcttatgaaaagtttgagatggaagtcatcaaagaggttgatttgaacaagattgagccgtgggatttacaagatagatgcaaaataggatcaacgccacaaaatgagtggtatttcttcagccacaaggataggaaatatccgacagggtcaaggacaaaccgtgcaacccactccggtttttggaaggcgacaggacgtgacaaatgcataagaaattcttacaagaagatcggcatgaggaagactcttgtattctacaaaggaagagctcctcatggccaaaagacagattggatcatgcacgagtaccgtatcgaagacactgaagatgacccttgtgaagatggatgggttgtttgtagagtgttcaagaagaaaaatctgttcaaagtagggaatgatgttggctcaaacatcagcaataataggcttgaagctcgtagtttcatccgaagagaaagcccttaccaaggaatctcaatgtttgagcttaacaagcctgaagagattagtgttcatcaatatcctcaaccaccaatgtttcaacctcatcacaagcctctttcaataggctatgactattcattggctcttctaccaagagaaagcgagtaccaacaagcgtgtcagccatcaggggttgaggttggcacgtgcaaggcagtaagtgaatggggaatagtgaattgtaacatggtgagtcatgaggactcgtctagagcgatgaggtttgaagatgacggtaacaacacttcttccacggtccagccaccttctaatctgctttcattgcgcggtgaaaatggatttcttgggttgttttaaacagat

SEQ ID NO: 284 - DNA, 1774 bp, Arabidopsis thaliana
tccccatatgtatcttacctacataatagccacatattactttgcttcactttgaaccattggttggttttgatcaaaaccaaaggatgtgtgtatgtatgtatatattctaacgctcaaaactgatcactagcattcctagatttttccttcttgtgatcacttgcagctatggccacacatgcagctctcgccgtctcaagaatcccggtcacacagcgactgcagtctaagagtgccattcactctttccctgctcaatgctcctccaagaggctagaagtcgctgaattctccggtctgcgtatgagtagtatcggtggggaagcatctttcttcgatgctgtagctgcacaaatcatccctaaggctgtgacaacatcaactcctgttagaggagagacagtggcgaaactgaaagttgcgattaacggttttggaaggattggtaggaactttcttaggtgttggcatggtcgtaaagactctcctctcgaagttgttgtacttaacgacagtggtggtgtcaagaatgcatcccacttgcttaagtatgactccatgcttggaaccttcaaggctgaagtgaaaattgtggacaatgaaactattagtgttgatggtaagctcatcaaagttgtctccaacagagaccctcttaagcttccatgggctgagctcggcattgacattgttatcgagggaacaggagtgtttgttgatgggccaggagcagggaagcatatccaagccggagcctcgaaagttatcatcactgcaccagccaaaggtgctgatatccctacctatgttatgggagtcaatgagcaagactatggtcacgatgtcgctaacattattagcaatgcatcttgcaccaccaactgtttggcaccttttgctaaagtcttggatgaagaatttggaattgtcaaggggacaatgacaaccacacactcctacaccggagaccaaaggcttctagatgcatcacacagggacctaaggcgtgcaagagccgcagcactgaacatagtgcctaccagcacaggagcagccaaggcggtgtcattagtgttgccgcagctgaagggtaaacttaacggcattgcactccgtgtgccaacaccaaacgtctcagtggttgaccttgttataaacgttgagaagaaaggtttgacagcagaggatgtgaacgaggcctttagaaaagccgctaatggaccgatgaaaggcattttagacgtttgcgatgcgcctcttgtctctgttgacttcaggtgctctgatgtctctaccaccattgactcgtccctcactatggttatgggtgatgatatggtcaaggtggttgcttggtatgataacgagtggggttacagccaaagagtggtggatttggctcacctagtggctagcaagtggccgggagcggaagctgttggaagtggagatcctttggaggatttctgcaagacaaacccggctgatgaggaatgcaaagtctatgactgaacaactttgatcatttctttctttatttttcaccaaaacaatactttgtatcatgagttacttattcgaaatcgtactatgcatacttgtttttctcataagattttcttgtctgatgaacaactatatgttaagactgagagaattgtatttgagaaataaccattttatgctacatgttaaaacggaatttatttgagcaatgtatgacaaaagaaattgtttgatttggtttacaaataaagatgcatgagtgtgc

SEQ ID NO: 285 - DNA, 1749 bp, Arabidopsis thaliana
gttttctgtgtgtctctctctttgtcccaccattttcaccgcttctcctccaatcactcagatctacagattcctttaaaacaacaatggttggatctttggaatctgatcaaactctttcaatggccaccttaatcgaaaaactcgacatcttatctgacgacttcgatccaaccgccgtagtcaccgaaccgttacctcctccggtaactaatggaatcggagctgataaaggaggaggaggaggagaaagagagatggttctcggtaggaatatacacacaacgtcactcgctgtaacggaaccggaggttaacgatgaattcaccggagataaagaagcttatatggctagtgttcttgctcgttaccggaaaactttggttgaacgaaccaaaaaccatttaggttatccttataacttggatttcgactatggtgcgcttggtcagttacaacatttttcgattaataatcttggagatccgtttattgaaagtaactatggtgtacactcaagaccttttgaagttggtgtgttggattggtttgctcgtctttgggagattgagagagatgattattggggttacattaccaattgtggtactgaaggcaaccttcatggcattttagtcgggagggagatgtttccggatgggatattgtatgcgtcgcgtgaatcgcattactcggtgtttaaagctgctcgaatgtatcgaatggagtgtgagaaggttgatacgcttatgtcaggggagattgattgtgatgatttgaggaagaagttgttggctaataaagataaaccggcgattcttaatgttaacataggaacgacggttaaaggagctgttgatgatcttgaccttgttatcaaaactcttgaagagtgtggtttctcacatgataggttctatattcattgtgatggagctttgtttggacttatgatgccttttgtcaaacgtgcaccgaaagtgacgtttaataaaccgatagggagtgtgagtgtatcgggccacaaatttgtcgggtgtccaatgccatgtggtgttcagataacaagaatggaacatatcaaagtcctctccagtaacgttgagtaccttgcttcaagggatgcaacaatcatgggaagtcgtaacgggcatgctcctttgttcctctggtacaccttaaacaggaaaggttacaaaggattccagaaagaagttcagaaatgcttgagaaacgcgcattacctcaaagaccgacttcgtgaagctgggattagcgccatgcttaatgagcttagcagcactgtggtctttgaacggcctaaagatgaagagtttgttagaaggtggcagcttgcttgccaaggtgatatagctcatgtggtggttatgccaagtgttacaatcgagaagcttgataatttcctgaaagaccttgtcaaacacagattgatctggtacgaggatggatctcagcctccttgccttgcatcggaggtaggaaccaacaactgcatctgtccagctcacaagtgacggcaccatttctcatttgttggtattgttgttttctagtaagccacatctagtttaaattcctcatcactgtattcctgaacttggtttcaatcatcgtaaaattttgtcagtttctcttatttacaagttaaggtttcaaacagtgtttacaatttgtagctcaatctggagcatgatcaaccttcacttcgtcgttcgcaatcgtttaccg

SEQ ID NO: 286 - DNA, 1618 bp, Arabidopsis thaliana
cattaaaactctgtttcctttttcagagattctcagagaagattcattttaccctaagaaaaaaaatgtcgaacattcttcagaatcggcgatcttcgttttcctcttcgacgaaatcttcattagcgaagcgtcaagcaccatcttcatcggagaattctgttaaacttatgccggcgatgacgaagaaacgagcaccgttaagtaacattaccaatcaaaaaatcgcctcacgattacaaaattctgattcggtacattgttcaaacaagtcagcgaaattgaagatagcaccaagtgtttgcgttaatgccagtttctctagcaatctgcaacaaagcatagttcctcacaaagttgcttcttcacctagcaaatctgatgatggctcagtatcaatggacgagactaggtcttcaagtgattcctacaagagtcctcaagttgagtatatcgaaaacgacgacgtttcggctgttgtttcgattgagaggaaagctttgagtaatctgttcataacgccgaattcagaaacaattgataattattgtagtagagatgtgttatctgatatgaagaaaatggataagaatcagattgttaacattgatagtaacaatggtgatcctcagctttgtgctacgtttgcttgtgacatttataagcatcttcgtgcttctgaggctaagaagcgacctgatgttgattacatggagagagttcagaaagatgtgaattcgagtatgcgtggaatcttagttgattggcttattgaggtgtctgaagagtataggcttgtaccggagacgttgtatttgactgtgaactatatagataggtatttatctgggaatgtgattagtagacagaaacttcagttgcttggtgtggcttgtatgatgatagcagcgaaatatgaagagatatgtgctccacaagttgaggagttttgttacattactgataatacatatctcaaagatgaagttcttgatatggaatctgatgttctgaattacttgaagtttgaaatgactgcaccaactacgaaatgttttctaagacgctttgttcgagctgctcatggtgttcatgaagctccattgatgcagctagaatgtatggctaactacattgcggaattatcgctactagagtacactatgctctctcattctccttcactagtagctgcttccgccattttcttggctaagtacattctagacccaacaagacgaccatggaactcgacgttgcaacactatacgcaatataaagcgatggagttgagaggatgtgtgaaggatcttcaacgattgtgtagtactgctcacggctctacactacctgctgttagagagaagtatagtcaacacaaatacaagtttgtggcgaagaagttttgtccatccgtaatcccacaagagttcttcaacaacagctaaaaatcctttaatttaactttgttccaatgttgtgttggatttaattgtttgattgtacatgattttgctgttgttggtctatttataaaattagctatctacgatctcactttgaaaacttgttaagctgatttattttggcttcctctagaaagtgacgtaattaggtg

SEQ ID NO: 287 - DNA, 2064 bp, Arabidopsis thaliana
aaaaagataaaatctcaaactttcttctaaaattcgttttccatttttcttcactctctttccggtgacgccatgaacgccgccgtgtttagtccttctgctttatctctccctatctccttctctaaaacccgatcctcttttctctccagaaagaagggcgtgaaaggagaatttagggtatttgctgtgtttggtgatgagagtggattagttgagaagaagagtcaatggagacctttgtttgatgtggaggatcctagatcaaaagctcctccttataaaggaaagtttttagatgttaatcaagctattgaagttgctaggtttgatattcaatacttggattggcgtgctcgtcaagatcttcttaccattatgattcttcatgacaaggttgttgatgtacttaatcctctagctcgtgagtacaagtccatcggtacagtgaagaaagaactagctggattgcaggaagaattatcgaaagcacaccaacaggttcatatatctgaagcaagggtttcgactgctttagacaagttagcccacatggaagaattggttaatgataggttgttacctggcagagttgtaacggaattagataaaccctcctcttcaaccactgcttctgctgtcgagttagatagggaaaagacaaacacgggtgcgaaaagcttgaatgtttctggtccggttccgccttatagtccacacttgaagaatttttggtatcccgttgctttcactgcagatctcaagcatgatacaatggtaccaattgaatgctttgaacaaccatgggttatctttaggggtgaagacgggaaaccaggatgtgtacggaatacatgtgcgcatagagcatgtcctcttgatcttggcacagtgaacgagggacgtattcaatgtccgtaccatggatgggaatactcaaccgatggagaatgtaagaagatgccgtctacaaagttactgaaggtgaagatcaaatcattaccttgtcttgaacaagaaggtatgatctggatttggcccggtgatgagccacctgcacctatacttccttctttacagcctccatcagggtttttaattcatgctgagcttgtaatggacctcccggtggaacacggtttacttctagataatctcttggatcttgctcatgccccattcactcatacatccacttttgcaaaaggctggagtgtcccaaggtttcttttaactctcattactctgttcagtgctaagatgaaacttggtttaagctttctgtttttggtactgcagtttggtgaagtttttaacacctacctcgggtctccaaggatactgggatccatatccaatcgatatggaatttaaaccaccgtgtattgttttatcgacaatcgggatatcaaaacccgggaaactagaaggcaaaagcacacagcagtgtgcaacacatcttcatcaactccatgtctgtttaccttcttctaaaaacaagacaagacttctataccgaatgtcactagactttgctcctatattaaagaatcttccattcatggaacatctgtggagacatttcgctgaacaggtcttaaacgaagatctacggctagttttaggacaacaagaacggatgttaaacggagcaaacatatggaatttaccagttgcttatgacaagctcggagttcggtatagactatggaggaacgcagtagatcgtggcgatgataaactacctttctccggctaactgttattaaagaaatctaatggaagtttttgcagctccttattcaccagcaacctcagacaagtgtaggttattaatctggtttattctcaccgaagaaagagctttgccgagtaaaagatctggagtttgtggattcatctaaaaaaccgatgaaacaaagaacttttgcgtagataaaaggacaacatccactgtaaatccaaaggagatatattgttattcatttttccctgtgtacagttcactctctatgagaaattgaatatcagttttccccactaaactaatgtcttctaagaacc

SEQ ID NO: 288 - DNA, 928 bp, Arabidopsis thaliana
agagtcagaacagaacaaaaacgtaagcaaaaaaaaataaaacagagcaaaatggccgtagttttacgtggaggcatcaccggaggatttcttcaccatcgtcgtgacgcttcatccgtcatcacaagaagaatctcatccgtcaaagccgcaggaggaggcatcaacccaacggtggctgttgaacgtgccacgtggctacctggactaaaccctcctccttatcttgatggaaatttagctggagattacgggtttgacccactcgggttaggagaggatccggaaagcttgaagtggtatgttcaagcagagcttgttcactctcgtttcgctatgctcggtgttgcaggaatactcttcactgatctccttcggaccacagggattcgtaatttaccggtttggtatgaagctggagctgtgaaatttgattttgctagtacaaaaactctcatagttgtacagtttctacttatggggtttgctgagactaaaaggtatatggattttgtctctccgggatcacaagccaaagaaggatcgtttttctttggacttgaagcagcactcgaggggctcgagcctggatatcccggaggaccgcttttaaacccattaggccttgctaaggatgttcaaaatgctcatgactggaagcttaaggagatcaagaacggtcgtctagcgatgatggcgatgctcgggttctttgttcaagcctctgtgactcacactggccctattgataaccttgttgagcatctctctaatccatggcataagaccatcattcaaaccctcttcacctctacatcttagtttcaggagtcacattactactgcttgcttgtggggtcacattactactgcttgcttgttcaccaaatgtaaacgttgttggttgatgcaaagccgatttagactt

SEQ ID NO: 289 - DNA, 1810 bp, Arabidopsis thaliana
aaagagaaagcaaagaagagaaactaaaacagagcttttttcacatgggaaaggataagactttgccgttgcttgaccctcgtgagccaccggaactcaccggaaccaagtcggcgtcaaaagtatgggccaaagagttcggcgaagagtcgaagcggctttgggagttagcaggaccagcgattttcactgccataagtcaatactctcttggtgctctcactcagactttctccggccgtctcggtgaacttgagctcgccgccgtctcagttgaaaactctgttatctccggtcttgccttcggtgtcatgttagggatggggagtgcattggagacgttgtgtggacaagcatatggcgcgggacagattaggatgatgggaatatatatgcaacgttcatgggtcattctctttactactgctttgtttttgcttcccgtctacatttgggctcctcctattctttccttcttcggcgaggctcctcacatctctaaagccgcggggaagttcgcattgtggatgatcccgcaactatttgcctatgcagccaacttcccgatacagaaattcttgcagtcacagaggaaagttcttgtgatggcttggatctctggagtggttttagttatacatgcagtttttagctggctcttcattctttactttaagtggggacttgtaggtgcagctatcactctcaatacctcgtggtggttgattgttattggtcagcttttgtatatcttaatcaccaaatcagacggtgcgtggactggattttctatgctagcgtttcgggacctctatggatttgtcaaactttccttagcctctgctcttatgctttgtttggagttttggtacttgatggttctggttgttgttaccggtctccttcctaacccgttgataccagtcgatgccatctccatttgcatgaatatagaagggtggactgccatgatttcgatcgggtttaacgctgcgattagtgtgagagtatcgaatgagctgggtgcaggaaacgcagcgttagccaaattctcagtgatagtcgtctccataacttcaactcttatcgggatagtgtgcatgattgttgtcttagccacaaaagacagcttcccttatcttttcacttcaagcgaagctgtggcagcagaaaccacgagaatagccgtcttgttgggcttcactgtcctcttgaacagcctccagcccgtcttgtcaggggttgcggttggagcggggtggcaggctctggttgcatacgtgaacattgcgtgttattacattatcggactacctgctggtcttgttcttggattcacactagacctcggcgttcagggaatatggggaggtatggtagctggaatatgcttgcagacacttatattgattggaatcatctacttcactaactggaacaaagaggctgagcaagcggagagtcgagttcagagatggggaggaacggcgcaggagtgatcaacaactcccttaggacgtggactatatcagttattgatctttttttgtcaatgttcaatgttgagaaaattgtttatcggagaacaacatcatctctttttgttttttgatatgcttaaagttaacgagtctctcagtgattgttagaggggtacggtttgttatgtgttagacttatgttagattctaggatggttgttgctaagccaaagttcttgattaattttaagtatgagatttaatcttcataagcttgttgatccttcgtttttattttaatggtcagacttgatccaatgtttatgttc

SEQ ID NO: 290 - DNA, 1464 bp, Arabidopsis thaliana
aaatcattgggctgggcctaaagaagtgcactacgaggagtccggttcaaaagacacgacttgacccgaccgatccgacccgggtaagaggttagcccaccacgcaacgtccgtcggggaagataccacgcgacggaaacgacgaacacgaacagcggaaatcgtcaattcaatctctcagatcagttttggaatcacatataacaatgtcggcggttctcacagccggcggaggcttaactgccggggatcgcagcattattacggcgattaacaccggcgcttcgagtctctcattcgtcggctcagccttcatcgttctctgctactgcctcttcaaagaacttcgaaaattctctttcaagctcgtcttctaccttgctctctctgatatgctttgcagtttcttcctaatcgttggggatccttcaaaggggttcatttgttacgcacaaggctacactactcatttcttctgcgttgcttcgttcttgtggacaactacaattgctttcactcttcatcgtactgttgtcaagcataaaactgatgtggaggatttggaagcaatgtttcatttgtatgtatgggggacttccttggttgtgactgtcatacgttcttttggtaacaaccactcacatttggggccatggtgctggacgcaaactggtcttaagggaaaggctgttcattttttaactttctacgctcctctttggggagccattctttacaatgggtttacttacttccaagtgatacggatgctaagaaatgctagacgtatggcagttggaatgtcagaccgagtcgatcaatttgataatagagcagagttaaaggtgttgaacagatggggatactatccactcattctaataggatcatgggcattcggcactattaaccgtatccatgatttcatcgagccagggcataagatcttctggctctcagttcttgacgttgggacagctgcactaatgggcttgttcaattcaatagcctatggtttcaacagctcagtgcgtcgagcaatccatgagagactggagctattcttgccagaacggctatatcgatggcttccaagcaatttcagaccaaaaaaccatctgattctacatcagcaacaacaacagcgaagcgaaatggtatcactcaagaccgaggaccagcaatgacactaactttcaactaatacattggaccgataacaagaaggcggcgatgataatagcgtttggatggagagattgatatggtgaaggggggtgcacaacaggttgtcaatgtatatgaaacattctttgggaacacgaacttaacaatttatttatttttgtatgaacttttttattgtgaggtcttctgatcttgatttgaaattaacgaacttggagttcttggacgacaatgttgaagagttttgttacgtaagtcatatgaaaatactatcac

SEQ ID NO: 291 - DNA, 1452 bp, Arabidopsis thaliana
gacaaagacatttaaaagaagaattttcgaagaaaaattagagagagtagaagaagcagaagcagtaatggtacgagcttcatcgtcgaagaaaggaggatcaaaaggaggagacaaagacgacgcagagtcaaaacagaggaagagattaaaaaccctagctctcgataaccaattgctctctgattctccggcgaaatctcattcctctctcaaaccttcaaagcaagttctcaaacaccatggcaccgacatcatccgcaaatctcagcgcaagaatcgctttctcttctccttccctggtcttctcgctcctatctccgccgctaccatcggcgatctcgatcgattatctaccaaaaaccctgtcctctaccttaatttcccacagggtcgtatgaaactttttggaacgattttgtatccgaagaacagatacttgactcttcaattctctagaggaggcaaaaatgtcttatgtgatgattattttgataacatgattgtgttctctgagtcatggtggattgggacaaaagaggagaatccagaagaagctcgtcttgatttccctaaagaactagctcaggttgatacatttcacctatttttacattttctctttaagactatggttgcgacagagatgtttaacatgatcaggagaattctttggtttcaggcagagaatactgagtttgatttccaaggcggtgctggaggagcagcttcggtgaagaagctggcgagtcctgaaattggtagccaaccaacagagacagactcacctgaagttgacaacgaggatgttttgtctgaggatggagaattcttggacgataagatccaagtaacaccaccagttcaattaacaccaccagtccaagtaactccggtccgacagtctcagagaaattctgggaagaaattcaactttgcagaaacttcctcagaggcctcctctggtgaaagtgaaggcaatacatctgatgaagatgagaaacctctgttggaacctgaatcttcaacaagaagtcgtgaggaatctcaagatggtaatggtattactgcatctgcaagcaagttgcctgaagaacttccggctaaaagggaaaaactaaagagcaaagacagtaagctcgttcaagctactttgtctaaccttttcaagaaagctgaggagaaaacagctggaacttccaaggctaaatcatcctcaaaagcttaaagaaatcttttccagaagaaaatagaggtctgttgtttctttgctgtgagaatgaacagtttttagttcttttaggtatgtttgtgtgagaaattgctacaagactgatgtattcatcatgcagttggataatgtattcattatgcttattcgatagtttgtgttcatcgagctatgtataaatcatctctgctctttttaatacaacaaactgtctccatcta

SEQ ID NO: 292 - DNA, 1215 bp, Arabidopsis thaliana
acgatttctctctctctcattaggctcgaaccctctttcactctttgtgtctgttaccaaactctacccctctctcttatccgctctattcagagaatcttttcttcaatggactttctctgaacactcaaatcgaacagagagtttaataaataaatggcgatgtctcatctctttctttcttcttcgcctcaatcttcactggctctgcgacttcactcgacgacccagttcacgttgagctactctaagaacaataaagattgttcctttcagagtgcaaatgaagctaaagtatcaaagagatcgttgctctgtcgtgcaattcatatggaatctggacattcaggggaacaaccaaagaagcttaatttcgataatctgttgaggagaaccaaacatgtttgggataattctccacagccggttaaggaatttccttggaatagagcattcggaaacttcatacagctcgttcttgatctcgctatatcagtcgttaagttcttgttcgttcctatattggcggtttcttccattagtgagatgtcttattgtgctcatgagaggaaacttgctttagtcccatttccattagtcatcggtatggttgtcgctggcgttctacaagaaaccgctttgaagatctcgcctcgtcttaaggaagcggaagtaccgtggcatttgatagctatgatgatgttcttcactctgattaagcttcctggaccatattacccgtattgggggcgtttattagttccacattttgcaaatggagtattacttagagcactttggtccatgttcttttggtataagaagactagaaacacatcaggaaatcctctgcagaatcacagtttggaaacagaatgagcatcttcatcaaaaggctggtgttttaaagtgccaagtggtcactttgattagtttcggggattatctggaacctcgtggagtagtgttcgagcatagataggagctttcttcttcttcttttctctcttcaatctcagagaagttgaggttaatgagttaacaacatcttttaggccatagaattgttttgttttgtgttctcttctttggaaaattgtctcagttcttgtgaaaaccgctattctttggatatgtatttgtatcttgagtttttgtttttggtcagacaaaattttatttggtaaactaagtaagaaaccaacccatgattgt

SEQ ID NO: 293 - DNA, 2473 bp, Arabidopsis thaliana
ctgcttaatctcctcttccttaaaaaccagaagatcctttgttccacgtttctcgtttgtagcttcttctctctcagaattcaattcgaattttgacaagtcttgacgaagaagaagaaacagagctgcttcaatggcttctaactcattactacgttcttcttcaaatttcttcttaggatcccatatcataatctcatctcccacccctaaaaccaccagaaaaccctctttccctttctccttcgtctcccgtgctaaataccaaatcactcgatcgtctcaagacgaaaattcgccaaatggtaaacccaattcgccattctcgtcgcaagtagccttagcagctattctactatcttcaatttcatcttcgccgctagctttagctgtagtggacgaaccagcttctccgtctgtcgttatagaatctcaagctgtgaagccatcgacgccatcgccattgttcattcagaacgagatacttaaggctcctagtcctaaatcatcggatctcccagaaggatcacagtggcgatacagcgagtttcttaacgctgtgaagaaagggaaagtcgagagagttagattcagcaaagatggttctgttgttcagcttactgccgtcgacaatcgccgtgcttcagtcatcgtccctaacgaccctgaccttattgatatcttggctatgaacggagttgatatatccgtctctgaaggagaatcctcaggcaatgacttgttcactgtcattggaaacttgattttcccgcttttggcctttggtggactcttcttgcttttcaggcgagctcagggaggccctggtggtggtcctggtggcttgggtggtcctatggatttcggacgttctaaatccaagttccaggaagtgcctgagactggtgtatcatttgcagatgttgctggggctgatcaagctaagttggagttacaggaagttgtggatttcttgaagaatcctgataagtacacagccttgggtgctaagattcctaaagggtgtttgcttgttggaccgcctggtacgggtaagacactcctggctagggcggtggctggggaagctggagtgccgttcttctcttgcgcggcctcggagttcgtagagctttttgtgggtgtgggtgcatcgagagttagggatttgttcgagaaggctaagtctaaagccccttgtattgtattcattgatgagattgacgctgtgggtaggcagagaggagctgggatgggaggaggaaatgatgagagagaacagactattaatcagctgttgacagagatggatggattttctggcaactctggtgtgatagttttggcagctacgaataggccggacgttcttgattcggctttgttgaggcctggaaggtttgatcgacaggtcacggtggataggcctgatgtggctggcagagtcaagattcttcaggttcattctagggggaaggcactcggtaaagatgtggactttgacaaggttgccagaaggacccctggtttcacgggtgctgacttacaaaacctgatgaatgaagcggcgattcttgcggctaggcgtgagcttaaggaaataagcaaggatgaaatctctgatgctcttgagaggatcattgctggacctgagaagaagaatgcagttgtctctgaagagaagaagagacttgttgcataccatgaggctggtcatgctctagtgggtgctcttatgccagaatatgatccggttgcaaagatttctatcattcctcgtggccaagctggtgggctcactttttttgctccaagcgaagaaagacttgagtctggattgtacagtaggagctaccttgagaatcaaatggctgttgcacttggcggaagggttgcagaggaggtgatctttggggatgagaatgtgacgactggagcatcaaatgatttcatgcaggtgtctcgtgtggcacgtcaaatgattgagagatttgggttcagcaaaaagattggacaagttgctgttggtggccctggtggaaatcccttcatgggtcaacaaatgtcatcacagaaagattactcaatggcaactgcggatattgtagatgctgaggtgcgagagttagttgagaaggcatacaagagagcaacggagatcataacaactcatattgatatcctacacaagcttgcacagctcctgatcgagaaagaaactgttgacggtgaagagttcatgagtctctttattgacggccaagctgagttgtatatttcttgattcctcaaagttgccattgcttagtgcttacaataccataagctaataagtatattcgtgttcatatgtgtcaccgattcagtactcaccaattcagtatatttgtgtatattccgttgttttagtgaatctaaatatactttgtaatgcaatgcaatttgtttaaagaaaagtaatttgatctggttt

SEQ ID NO: 294 - DNA, 2136 bp, Arabidopsis thaliana
attttgtttgcagccatacttggagaaagcagaactagatctcttcctcttctcaatccttgacaaatcaaattatatacctcactggtttaagctttgattccaagaaaagggaaatgaattctaacaactggctcgcgttccctctatcaccaactcactcttctttgccgcctcacattcactcttcacaaaattctcatttcaatctaggtttggtcaacgacaatatcgacaacccttttcaaaaccaaggatggaatatgatcaatccacatggtggaggcggcgaaggtggagaggttccaaaagtggctgatttcttaggagtgagcaaatcgggggatcatcacaccgatcacaacctcgtaccttataacgacattcatcaaaccaacgcctccgactactactttcaaaccaatagcttgttacctacagtcgtcacttgtgcctctaatgctcctaataattatgagcttcaagagagtgcacacaatttgcaatctctcactctctctatgggaagtactggagctgccgctgcagaagtcgccactgtgaaagcctcgccggctgagactagtgccgataatagtagcagcactaccaacacaagtggaggagccatcgttgaggctacaccgagacggactttggaaacttttggacaacgaacctctatctatcgtggagttacaagacatagatggaccggtagatatgaagctcatctttgggataatagctgtagaagagaaggacaatcaaggaaaggaagacaagtctacttaggtgggtatgacaaagaagagaaagcagccagagcatatgatctagctgcacttaaatattggggtccctctactactaccaactttccgataactaactacgagaaggaagtagaggagatgaaaaacatgacgagacaagagtttgtggcttctataagaaggaaaagtagcggattctcgcgtggtgcatccatgtatcgtggagtaacaaggcatcatcaacatggaagatggcaagcaaggatcggccgagttgctggaaacaaagatctctacttgggaacattcagcacggaggaagaagcagcagaagcttatgacatagctgcgataaagtttcgaggtctaaacgcggttacaaactttgagataaatcggtatgatgtgaaagccatcctggagagcaacacacttcctataggaggtggtgcggctaaacggctcaaagaagctcaagctctagaatcatcaagaaaacgagaggaaatgatagccctcggatcaaatttccatcaatatggtgcagcgagcggctcgagctctgttgcttccagctctaggcttcagcttcaaccttaccctctaagcattcaacaaccttttgagcatcttcatcatcatcagcctttacttactctacagaacaacaacgatatctctcagtatcatgattcctttagttacattcagacgcagcttcatcttcaccaacaacaaaccaacaattacttgcagtcttctagtcacacttcacagctctacaatgcttatcttcagagtaaccctggtctgcttcatggatttgtctctgataataacaacacttcagggtttcttggaaacaatgggattggtattgggtcaagctctaccgttggatcatcggctgaggaagagtttccagccgtgaaagtcgattacgatatgcctccttccggtggagctacagggtatggaggatggaatagtggagagtctgctcaaggatcgaatccaggaggtgttttcacgatgtggaatgaataaaagatgaattctctgtgttttttgcgaggcaaggtagggtatggaataattagctactttaatttccacaagtattaggatcggctggagtcttcttgattagtagaggatttagtgttttattttcttacttttgacggcgaagatgataaaacttgtagacggcggttatcagagtcctcgagggttagtctttttaggggtactatagtaacattagaaagtacccgaattttgtttaaaagctaacccttctgactaatttttcaaacttgtattcgtaatttataattgaagatttattgttcttata

SEQ ID NO: 295 - DNA, 664 bp, Arabidopsis thaliana
acaaattacatcaatccactcacttactttggcaacaaacaaacaacaacaaagagagaaattaacatggcgtcttttgcaaccatcgccgccgtacaaccttctgccgccgtgaaaggacttggaggtagctctcttgccggagctaagctcttcatcaaaccttctcgccaaagcttcaaaaccaaatccaccagagctggtgctgtggtggctaagtatggagacaaaagtgtatactttgatttagaagatttgggtaacacaacaggacaatgggatgtgtatggatctgatgctccttctccttataacccacttcagagcaagttctttgagacatttgctgctcctttcacaaagagaggtttgcttctcaaatttttgattcttggaggaggctctttgcttacatatgttagtgcgaactctaccggcgatgttcttccgattaagagaggtcctcaagagccacctaagctcggtcctcgcggcaagctttaaattagctttctaaaatctttcaaaaagtcagaaactttctccccaattctatgaaccctatttatgtatattgtactgtgttgtgttaattgctttgtaagctagtgattctgaaaatcagttatgatgaatcaatgaaattgcatttcaagtctgctac

SEQ ID NO: 296 - DNA, 1280 bp, Arabidopsis thaliana
aaacattattgtcaaaaataagaaagaaagaaaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgcatattgatatattgtttagttgtggctagctatacatgtaagtttaattgtttgagctatcc

SEQ ID NO: 297 - DNA, 1844 bp, Arabidopsis thaliana
cagaaacagagacaaattctaaaaaagaaacaatctttagacaaaagaagagaaatttagtcatgggttagtctgcaaaattcaattacgtcttcttcttcttcttcttcttcatctttgatttgttggcgtgtttagggtttgggatttggaggagaggcaaaatgttgaattaaataaatcgaacgactctggattcctcggcggttaacgaccgccgtcgccgccgccgtcataatccaaccaccaccaccatcaacgaccttgaatttccacaatatgcttcatcaatggcaccagataacgaccatttcttagattctccgtcgccgcctcttctagagatgagacaccaccaatcagcgacggagaacggtggtggttgcggcgagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaaacaagttccaaaaacacataagattgtgcaacacaacaggtttcttttcatattccagggcgcttcgaatgcgtggaatagtgaaggcggttttcgttgttgtgtgtttcgaatatccaaatggcctataaatctgatcaacagtttcaggttcttcttaagtctttaaaagcctaggccttggttaatttgaattcatcttgtatcaattagagaacgttctgtaagttcaattctgttttacaatgtttagctctagctacatgagctcacatcttgtttgttgtaacttgttctacaattacttgtcctttatttatgttcttgtgttggaaacctttaaccccacttgaagctaaagtcttttgtttgcccttt

SEQ ID NO: 298 - DNA, 780 bp, Arabidopsis thaliana
agaatccaaaaccaaaccttcagatcataaatccaaaaccactcatttttctattactgaaatttttcttagagaagaagaagaagaagcaaaatggccacaagcgcatcagctttgctctcaccaaccacattctccactgcaatctcccacaaaaaccctaactccatctcattccatggccttcgtcccctccgtctaggtggctcctcctccgccctacccaaactatcaaccaccgggagaaaatcctcctccgctgtcgtgagagctgagctaagcccttccatcgtcataagtctcagcacaggtctctccctcttcctcggccgtttcgtcttcttcaacttccagagagagaacgtagcaaaacagggcttaccggagcagaacggaaaaacccatttcgaagctggagatgatcgtgctaaggagtacgtcagtctcttgaaatcgaacgatccaattggattcaacattgttgatgttcttgcttggggttctattggacacatcgttgcttactacatcttggctacttccagcaatggatacgacccaagcttctttggatgattcgtttcaatgtcaatctctcgtatatgtatatgtatatgtttgacttgtgttgcaagctatctaatctgttctctatctctgtttcttcttctgttgttgttgttgttgtctaagacttgtccctctttttgcaaatgttttatttctccatttacaaagattggtttgcagagttttataagaagaacataatagtatata

SEQ ID NO: 299 - DNA, 1113 bp, Arabidopsis thaliana
ggctatttagattcttgcaatagaagccaacgctttaaaattgatttgtgcgagaattttacataaaccctaagaaagatctttgttttttccgtctttttgcgttttagtcttcagttatgccggtaatgaatccatcattgtgtattggtacacaaacatcggtgtacctcgctcctcgtgagaaatcttttacgagtaatggaaactctcaaaggcgttatcctacaagcgtttctatgcaacgccagccttggagccaaagtaaattcccttctctccaggatgcagtgcaaccagttgtcgtctctaagaataaaagaccagtctttgcatgtaactctgcgctgaattcaaaatgcagtcaaggacaaacacagaccgttacacggcaatcaccaacaatcacacaagctcctactcatggtaaattgtttcatccccttctctatgttgaacaactattttgcgtttctaacaaacaagaggggcttaaaaaaccatacgattctagctaatatgaaacagttattttgaactcaaattgtggcttgctatggttcttattcttgagaatgtgctttaacagaaacggactggtctattcttgtttgtatcttcagaatttatttttttagccttaacttaaatatcaggaaaagttaaatccccaaagcttgatgacggtggaaacgggttcccacctcgggatgatggtggtggtggtggtggcggaggcggtggagggagctcttcaggtggattcttccttttcgggtttcttttgttcatgggatacttgaaagatttggagggcgaacatgaaaacaaccattaaatcggaggaaaacatgatgcacaagcacaacagacaaatctcaagacaagtattctccaagagaaatctctgtatcaaaaacaatagattctagtactagcaataggcacagatttgagttgttatttatgttttctctgttgggttatgaatgagattcttgttccgtgacacaaacaaagctcatcttatccaaatgtttatggaaccaggtttgggagatgcagagaatcacacataaatgaattcaaaatgtacccttgttcttttgtttt

SEQ ID NO: 300 - DNA, 1928 bp, Arabidopsis thaliana
aagcccgccaaatccacacacagagacaacacttgtttctctctatctgtcctctccaatggccgccaatttctgcggcttgacgcttcagtctccgtttctctataactttagtcgcccaacgatcagatcttcttccttcatacggtcttcgtcttcttcatcagcctcttccaatggcaatcttaaagaacccttctctggggagcctgaagcagatgttgtggtaattggaagtgggataggaggattatgttgtggtgcattgttagctagatatgatcaggatgtgattgttttggagagtcatgaccatcccggtggcgctgctcattcctttgagatcaaagggtacaagtttgactcaggtccttctctgttttctggtttacaatcgcgaggtcctcaagcaaatccacttgctcaagttcttgatgctttaggggaatcatttccatgtaagaaatatgattcttggatggtttacttacccgaaggtgatttcttgtcacgaataggccctacggatttctttaaggatcttgagaaatatgccggtccaagcgcagtgcaggagtgggaaaagcttcttggagcaatactccctctgtcttctgctgctatggcgttaccaccattgtctattcgcggggatcttggtgttctctccacagctgctgctagatatgctccttcgcttttaaaatcttttatcaaaatgggtcctaaaggagcgttgggagcgacaaaacttctccgcccgttctcggagatcgttgattctttggagttaaaagacccgtttatacgaaactggattgatcttctcgcattcctgctcgcaggggtcaaatctgatggcatactttcagcagagatgatctacatgtttgcagaatggtacaagccaggctgcacattggagtaccctattgatggcaccggtgctgtggttgaagcgcttgtccgtggcttggagaagtttggtggacgtctatctcttaaaagtcatgtcgaaaacattgttatcgagaatggtaaagctgttggagtcaagctaaggaatggtcaatttgttcgagctagaaaagctgtggttagcaatgcatcgatgtgggatactttaaagctcttacctccaggagctctcccagaatcatatgtaaaaggtgtgaacacaacacctcaatgtgaatcattcatgcatcttcacttgggattcgacgcagagggaatagcagatgatcttgagattcatcatatcgttgtgaatgactgggaccgcggtgtggatgctgaccagaatgtggttctgatatctgtccctagtgttcttagcccaaaccttgcaccaccgggaaaacatgttctacacgcttactgtcctggaaccgaacctttcggtctgtgggaaggtcttgatagaagaagtgccgagtacaagaatctcaaatcccaacggtccgaggtgatgtggagagcggttgagcgggcattagggctagggttcaaaagagaaaagtgcgaggtgagtttggttggaacaccattgacgcatcagaggtttctaaggaggaatagaggaacatatgggcctgcaatagaggcaggtaaaggtacttttcctggccattccactcccattccgcagcttttgtgttgcggtgactcgacctttcccgggatcggagttcctgcagtggcagctagcggcgcgattgtggcgaattcgctagttcctgtttccaagcattcacagcttcttgatgccattggcttgtagaaagatgtgatattaatcttatataataaagttagtttccttcaaactcatattcttaaaagttagacatgatcttgcttttgacatgtctttttaaaaaactcaaatgtattagtacatatcatataattatatcattatattt

SEQ ID NO: 301 - DNA, 2083 bp, Arabidopsis thaliana
agcctcaaatctgacaaatcatattcacagcgatctccttcttccacatcgcaacccaatccctctctgtctcttcctcaattcttattctctctcgcaaaggtttggttttttgaagacagagaggagatttgagattttgggtttcaatggcggtttcaagtgctttcgttggttgtccaaagcttgagactttattgaatcaccataatctatctccttcttcttcttcttcgtcctctgtttcacagacaccattgggtcttaatggggttcgtgttcttccgaagaacaatagaaccagacgaggtttgatccaaaaagctcgttgtgagctctctgcttcttctgattctgcgtctaatgcagctagcatctctgctcttgaacaactcaagaactctgcagctgatcgatatacaaaggaaagaagcagtattgttgtgattggacttagtattcacacagctcctgttgagatgcgtgagaagcttgctatacctgaagctgaatggccaagagctattgctgaattgtgtggtttgaatcatattgaagaagctgctgtgcttagtacttgtaaccgtatggagatttatgttttagctttatctcagcatcgtggagttaaagaagttactgaatggatgtcaaagacgagtgggatcccagtttcagagatttgtcaacaccgttttctgttgtacaacaaggatgctacacagcatatatttgaagtctcagctggtcttgactctcttgtcctaggagaaggtcagatccttgcacaggtgaaacaagttgtgaaagttggtcaaggagtgaatggctttgggaggaatatcagcgggctgtttaaacacgcgataactgttggtaagcgtgttagaacagagacaaatattgcttctggtgcggtttcggttagctcagctgctgttgaacttgctctgatgaagcttccgcagtcttcaaacgtatctgctaggatgtgtgtaattggcgctggaaaaatggggaagcttgtgattaagcatttgatggctaagggttgcacaaaagtggtggtagtcaacagaagtgaagagagggtttcagctatccgtgaggagatgcctggtattgagattatatatcgacctcttgatgagatgctagcttgtgcttcagaagcggatgttgtgtttaccagcacagcctctgagacgccattgttcttaaaggagcatgtagagaatctccctcaagcttctccagaggttggaggactgaggcattttgttgacatctctgttccgagaaatgttggatcttgtgttggtgaagtagaaacagcacgggtttacaatgtggacgatctcaaagaagttgttgctgccaacaaagaagacaggatgaggaaagcaatggaagctcaaaccataatcacagaggaatccacacagtttgaagcatggagggattcattggagacggttccaacgatcaagaagttaagagcttatgcagagagaatcagagtggcagagctcgagaagtgcatgtccaaaatgggagatgatatcaacaagaaaacaacgagagcggttgatgacttaagccgaggtatcgtgaacagattcttacatggtccaatgcagcatttgagatgtgacggaagtgacagtagaacgctgagcgagacccttgagaatatgcatgctttgaacagaatgtacggtcttgagaaagacattttggaggaaaagcttaaggcaatggcggaacaacaacagaagtaaaagagaaaaataagaagatgttcatctcttttgacatataagattagcttccccacaaactctgagtaaattgcatagatcctatagcgatggatctatttgattcatttaatttgtgtgcaagagactaacaattctatcgtcaagtgtaagtgttgtgaagctataagcgagcttgttgcatgtttgttgcttcatagactcgagtgtaatggtattggtcccagtatcgttacatatatgtaataatgtataaactttggttcttgcaatatagagaaatgtttttttctttctaatct

SEQ ID NO: 302 - DNA, 1051 bp, Arabidopsis thaliana
gaaaatataaaacaaagtagagaggaactagtagcaatatctctcttctatcttttcatttcctactcttttctcactatggccaaagacggtggcgtttcttgtctacgaaggtcggagatgatcggtataggaatcggagaacttgaatctccgccgctagattctgatcaagtccacgttctcgccgttgatgacagcctagttgatcgaatagtcatcgaaagattgcttcgaatcacatcctgcaaagtcacggcggttgatagcggatggcgtgctctcgaattcttaggattagacgacgacaaagccgccgtcgaattcgatagattgaaggtggatttgatcatcactgattactgtatgcctggaatgactggatacgagcttctgaaaaagattaaggaatcgacaagttttaaggaagttcctgttgtaattatgtcgtcggagaatgtaatgactcgtatcgacagatgtcttgaagaaggtgcggaggattttttactaaaaccggtgaaactcgccgacgtgaaacgtctgaggagttacttgacgagagacgttaaagtcgccgccgaaggaaacaaacggaagctgaccactccaccgccgccgcctccgctctcagccacatcctcgatggaatcttcggactctacggtggaatcgcctctgtctatggttgacgatgaagattcgttgacaatgtcgccggagtctgcaacttcgcttgtggattcgccgatgaggagtcccggattagcttagagagatccgtgtgataacgatctccgttaactttttacttttgacggttttattgactgcaacgttgacttgaacgccgtcagtttatacttatagatctctctctctctttttatatcgttgcacgtggggtctctttgctcacgaaggaacttttataaaaacaagtattgtatttatttaattacgtatatttgataattttaaaattaaataatgtttctatttctaataatatcataataatcaaataatgtgtgacagtttacctctgtgt

SEQ ID NO: 303 - DNA, 1742 bp, Arabidopsis thaliana
acgtgattttatcttccaacgagggagcttctgttatccacttcatcattcacgtctcttccgcaaaacccaacattcaaattcttgtctgaataacgaaatcccaacatttgcattgcatagattccttcacaaatcctctgattctgattctggtcactcaattttgcctgtttattggcataattcgggcacttttctctcagtttttgtataaggttcaatgagtttgttctgtacttctgtgtgcgttatcttctccaaattaagattccagattcgtgggttcatgaaaatctcgttgtagacgagccaagttgaaatatttttcctcaagtgaattttgttatgatcacgtcgtggttttgatctgactccacttccgtcgctaactctcttcgaaagattcgtgttaaaaaagaaacctgaaaatggtgaattttgtttctctctgtgacataaagtatgggtttgtgcccaaaaattcaactgatttgtttgtgaaacggaaaattcacaagcttcccagcagaggagatgtaatcactagattaccggtgtttggttcgaatgcacgagagaatctgaatgctaaaccaagaagaaaccttagagttaggccaatcttttgtaagagttatggagatgcagcaaaggtttaccaagaagaggagattcccagagcaaaattgatatggagagcaatcaaactaccaatgtactctgtcgctttagttcctcttaccgttggcgcttcagcggcctatttagagacgggtttgttcttagctagacgttatgttactctattgctctcatcaattcttatcattacttggctcaacctaagcaatgatgtttatgattttgataccggagctgataagaacaaaatggaatcagtagtaaatctggttggaagccggacaggaaccttagccgctgcaatcacatcgctagcgcttggtgtttctggtctagtttggacatcgttaaatgcaagtaatatccgtgcaatactattgctagcctcagcaatactctgtggctacgtataccagtgtccgccatttcggttaagttaccaaggattaggagagcctctatgctttgcagcatttggtccatttgctactactgctttttatctacttcttggtagctcaagcgagatgaggcatcttccgctaagcggtagggtcctttcatcatctgtccttgttggttttactacatctcttatccttttctgcagccactttcatcaggtggatggagatttagctgtggggaaatattcacctctggttcggttagggactgaaaaaggagcttttgttgtgagatggactattcgtttactatattcaatgcttcttgttcttggtttaaccaggattttgccactaccttgcaccttgatgtgcttcctgacattaccagttgggaatttggtttcaagctacgttgaaaagcaccacaaggataatgggaagatattcatggccaagtattactgtgtgagactccacgccttgcttggagccgcattgtcgttggggctagttatcgcgcgctagaaatcagtcaccaaacatttgtttctctctttagccttcgttgtatctacctaaacgtttagccactacagtatgctgtagctaaaaggaaacattcgaacttacaacagttgtgaaaggtctcaaattaatcacaagcatggtgagcgattgtatcctcaa

SEQ ID NO: 304 - DNA, 1327 bp, Arabidopsis thaliana
ctgaaactaagcatgagctgttttttcttatactgacgaaaacaccctcaagtcattttcgttcttcagttcttcttcttctttttgattaaagaccccatgagaagtttaaattctcactgacccatttgttttctctcaatcttttgcagaaccctgaaccaaattttgcatctttctctttgaattttgtgtctttctttaattctttggaggggtttttcaaaagcaacaaccttgaaaaaatgggtatgggcacaagcactttcgttatcagatgggtcaatcttcttacaatgctattggctgtggcagtgataatatttggggtgtggatgagtacacacaatgatggttgcagaaggtcacttacatttccagttatagctcttggtggtttcatcttcttgatatccataatcggatttcttggcgcgtgcaagagaagtgtggcgcttctttggatttatcttgccgtgctcctgatcgttttgatcgcgattcttgtctttaccgtactggcgttcattgtaacaaacaatggttctggccatactaaccctggtttaaggtacaaggagtataagctgaatgattacagctcatggtttctaaaacagcttaacaacaccagtaactggataagactaaagagttgtcttgttaaatccgagcaatgtcggaagctttccaagaaatacaagaccatcaaacagttgaaatccgcagaattaaccccgatagaagctggatgttgtcgaccaccatctgagtgtggttatcctgcggtgaatgcttcttactatgacttgagctttcattcgataagttctaacaaagattgtaagctttacaagaatttgaggactatcaagtgctacaactgtgattcttgcaaagctggagttgctcagtacatgaaaaccgagtggcgacttgttgcgatcttcaatgtggtcctgtttgttgtcttgataagctctcttcttagcacgagatttgactctgaacaaagttttggccttttaaacgtcaatggtttactttgttggatgctgtgcgagaagaaatgctgctagttaccgatccaaagcttagaaaccgaagcccgggttaaagaaaacacttcaccggattctcccaagctacagatgaatcacattctcttccatgttggtgaatgcttccaagagagacacaagagcaacaacttctcatcgttctttttactctgtaatctatatgttgttgaaacagagcaaaaatttgatcagatttttcacacagaaaacatatttgacatcaaaatctacactttttatctttt

SEQ ID NO: 305 - DNA, 904 bp, Arabidopsis thaliana
atggctacttcttctactcagcttctactgtcttcttcttctttgtttcactctcaaattaccaaaaagccattccttctcccggcgacgaagatcggcgtttggagaccgaagaagtctctctcgttatcatgtcgtccttcagcctcggtttcagctgcttcttccgccgtcgacgtcaatgaatctgtgacttcagagaaaccaaccaaaacgcttccgtttcgaatcggtcatggtttcgatctacatcgtttagagccagggtatcctctgatcatcggtgggattgttattcctcatgatagaggctgcgaagctcactccgatgtggatgcaattttgggagcactaggccttccagatataggtcagattttccctgactctgatcctaaatggaaaggagctgcttcttctgtattcatcaaagaagctgtgagactcatggacgaggcagggtatgagataggaaacctagacgcgacgttgattctccagagaccaaaaattagtccacacaaagagacaatccgatccaatctgtccaagcttcttggagcagatccttctgtagtgaacttgaaagccaaaacacatgagaaagttgatagcctcggagaaaacagaagcatagcagctcacactgttattctcctcatgaagaaatagaagtcaaaattgattttagctctttatcatattccttaaagtgtctcatcttttaagaaaaacatacttttgattgtaaagtgtaatcatcctttaaaggttaattaatcgaatcgtttcgtagaagcagagaaaatcgaatcatattttgttgatgattcattgtgattcctagttccttggtcagatttgaatataattggaaactgtgtcttggactgcaagttccttg

SEQ ID NO: 306 - DNA, 2767 bp, Arabidopsis thaliana
aagaactctgagaaaaaaaaaatccaaaatcaaaatcacgaaaggaacaacaaatctccactcagctcgtgtttctcgcaatcgatttcttagattctagatcttgtttcaattttcctgggtttatagattcccgaatttttctagtttttttttttgcgatggacgaagtttcgacggtgaatgaaaatgagaatcggaagacgatgatagagccaaagaagctgaataagcggaagagagaacccacggcgattgagaatctaacatctgaggagaaagaatctcagatctcgtcgttgaatctagagatgaaagggctttttgattatttcagagaagttatggataagagtaagagaacagatctgttttctggatttagtgaatgttcctcattgaattcgatggtggctttgttaatggaggaaatgagtttgccgttgtcgaagcttgtagatgagatttacttgaaattgaaggagaagactgaaagtgttactatggtagctgtgaagagtgctgttgtttctgttggtcagagagttagttacggtgtgcttaacgtagatgctgatgttttggaggatgattctgaatcttgtctttggtgctgggagacgagagatctgaaaatcatgccgagttccgttcgtggagtgttaaaacttcgccggacttgtcgaaagaagattcatgaaaggattacagcagtttctgcaatgttagctgcattacaaagagaagaaactgaaaagttgtggagatctgatttgagtaaagctgctgagaagcttggtaaaatactgagtgaggtggatattcgatcattcatggataacatgatgcagaagaacagctcagaaatggctgagaaagactcaaagagagaagagaagctgcttcttaaacaattggagaaaaatagatgtgaagctgagaaggagaagaagagaatggaacgtcaagtattgaaagaaaaattgcaacaagaaaaagagcagaagctactgcagaaagcaattgttgatgaaaataataaagaaaaagaagagacagagtcaagaaaacggataaagaaacagcaagatgagtcggagaaggagcagaagcgtagagagaaggaacaagccgagctaaagaagcaacttcaagtacagaaacaagcttcaatcatggaacggtttcttaaaaagagcaaagatagttcattgacccaacccaaacttccttccagtgaagtaactgctcaggagctgtcatgtacaaaacatgagaatgaaattggaaaagttgttcaggcaattgacaacgccttttcaacaacttgtgaagctacagttgatgatattcgcagggaacactttgcttcctggcgtcagttgggtcatttgctctcgagttcgaaaaaacattgggggatgcgtaggcagcctaagagtgaactgtttccaaaactaaaactatctacaaatagtggagtaacatctgacggtgaacctaacatggagaagcaaggggatggatgtgaagagaataactttgatggtaggcagtgtaagccttcctcatctaatcgtaagaagtccaggagggtcaagcagttgttacaatttgataaaagctgcagaccaggcttttatggtatctggcccagccaaagtcaagttgtaaagccacgtcgtcctctgcaaaaggatccagaattggattatgaagttgatagtgatgaagaatgggaagaggaagaagctggtgaaagcctttcagattgtgagaaagatgaagacgaaagtttggaagaaggatgttcaaaggctgatgatgaagatgatagtgaagatgactttatggtgcctgatggatatctctcagaagatgagggggtccaagtggacagaatggacattgatccgtctgaacaggatgcaaatacgacatcatctaagcaagatcaagaaagtccagagttttgcgcattactccaacaacaaaaacatctgcaaaatttaactgaccatgctctgaagaaaacgcagccactgatcatatgtaacctaactcatgagaaggtctctctcttagctgctaaagatctagaagggacacaaaaagtagaacaaatatgtctgcgagctctcatggtgcgacaattcccttggtcttctctcattgagatatcgatcaacgacattcaagatgaagatcaagaagccagcaagttttcttgtagccagagcactcctccatctaattcaaaagcaaaaatcataccagactcagatttgcttacagttgtatcaactattcaatcatgctctcaaggtatcaatagggtagttgaaacattacagcagaagttccctgatgttccaaagaccaagcttagacaaaaagtgcgtgaaatatcagatttcgaggatagtcgttggcaggtaaagaaagaagtattgacaaagcttggattatcaccgtcaccagataaaggcggtaagagattaccgaaaacgatatctacattcttctcaaaacgttgtttacctccatccacaaaaccacaacctgcagttgaagacgcagcagagagattggaaaacgaaaatgcttaagtctactcacagtttccatctttatttttttggttacatccatccctcaacttggctaaatcctttttgtttgcttcttgtggatatgtataatgctcaatatcggtaaaaatgtttgagatgagggaaatgataaaatggtttaagtattaagaagc

SEQ ID NO: 307 - DNA, 1629 bp, Arabidopsis thaliana
gtggttacaattttcacttctaatcccataattctccttctttgtcctcttctttctccctaaaatcctaaatccttctttggattactcttcttcttcatttcttcccacaaggtttatctcaatggctcttaacgtgagcaaggttgttcccaatagtccaattttagttaagagtgttaatgcttcaagatctcgaagagttctgttggcgtatgttcatcatcctttagctgctaataagggttcatctattgaagagttaaagcaaggtctttgttgtacaaagactgtcacttttgttagttctcggagatgttctacattgtgctttgttggaaagtctcaagacactgaaactaattcccaagttgtacaaaaagaaggtgagaagcaagtgatgccgaggaggaaaagtagtaactcaagccaacttttggtggaatatgtgtctaatgatgctaagtttgtgaatgaaagagctcgtaatgactttgttcttctatctcgtggtattatgagacttgatgctcgtgcacgacaggatgttgccattcttggttccgggttccttaaactcgatgctcgggcaagagaagatacagagaaaatagaccgtgatgtcaagagaaaagccgagcgccttcatcatattgctactatatttaaaaacatagctgagtctaagttgaaaaatgccgctgataagcattggagcgatggcgctttagaggctgatttaaggcgagcagatttccgtgctaaacaacgggccatggaagacgcattaatggctttagagtttattaagaacatccacgacatgatggtgaacaaaatggttgacagcttggtgacatctgaaactggtaccacggatcgcatatcgcttgagaagaatggaatagctctcgggtttttccctggggaagtttcatctgatcgcatatctgctattgaggaagcttacaagagtatggcatcagcgctctcagaagccgatggaattgactacactgaccctgaagaactcgagttgttagtcacgactctgattgaccttgatgcaatggatggtaaaagtagtgcatctctcttggctgaatgctcaagctctccagatgtcaatacaagaaaagcgttggctaatgctttagcagcggcaccatcaatgtggacactaggaaatgcaggaatgggagcattacagagactcgctgaagacagtaacccggcgattgcagcagctgcttcgagagcgatcaatgcgctgaagaagcaatgggaagtagaggaaggagactcactgaggtttatgatgaacttcgagaggccgaatgatgatgatgatgtagacagtgaccttgatgagatctgaaaatgattttttcatgtaaacgaagatgaagtttgtagataattttcagtgaactttagtgttacagagatgatagtaggtgacttcgttggggtcatgtaattaattaaaactggccgatttagtattttgttgttgagatattcatatataactctttggagtttaagttgtattaaactattatgtgttttgttgttacacataatgataacaagaatgagaaacgtttagaaagaacgaacttttct

SEQ ID NO: 308 - DNA, 990 bp, Arabidopsis thaliana
atgacgaaattgggaagacgcaacgacggaggaggaaaaagccaccgtagctcaacgaagaggcaacggcgtacttctgtttccgtcgacgaccctagtcccggggaagaagaagagaaaacccttgtggtgcttaccgatgatagcgattctgaggaggatgataaaccgctcggagatgttcttcgaacatgcagaaaacggagggtttcatcacccaaatccgtaactctcccgaattcgaatgttcttgaatgtcccaattgcttcgacccattgaaaaaaccaatctttcagtgtaataatgggcatctagcgtgtttcttgtgctgcatcaaattgaagaagagatgctcgttctgcaaattgcctataggggatgttcgatgcagagccatggagaaggttataaaagcagggttagtctcatgttcaaatgcaatatacgggtgtaaacagagcaccacgtatggaaatcaactgcaaagccatgagaaagtttgtgtttttgcgccatgttcatgtcccataaaagattgtaactacattggcttctacaaggatctcatcaaccactttcgcgctacacacaaagtgagtccgggtgatatcaactcgtttgtgttcgaccgtcctgtaatctttggcttggatctggacagcagtgataagatggtcatttttgtagaagagaaacaagggaatctgtttgtagttcaaggtttcatcggatcacacggggtgtatgcgacggtcagccatattgcacctatggttcccgaagtgcgcaaattctcctgcagtctagctagactcagaccgtatagcacactaagacttggattggaggtgaagaatatacagaaattgagatctcaagaagagcagcctcaggaggacttcttgttgattccatcttatatggtgaatggtgatcacatgaagatggagatttccattggcgataaaaatgactatactcatatctga

SEQ ID NO: 309 - DNA, 1571 bp, Arabidopsis thaliana
cagacattttcaatttcactcctccgtcactcttctccgttcctccgtcacaccgcgatttttcacggcggagttggagttagattcaaattccttcgcagcttttctcctctctcagcaagacgagataatcccgatgtctccagaaaaccccaaccgagcaaaaatatgctcagagcgaagcacatcggtaaaaattactcctcctccttgtcaccagttctctcgccggagcataaaccttcgctcttagagtctcaagctattggtactgtcgcaacagctcaagcgaactttatgcgcgtcattgttcaagatgtagctaattctgtgacgagtgatgatgataatgattcttcaaagactggtgttgaattgctttgtgtggtgagagctgtgttgaagaaaatacgaaggagagttttagttggagataaggttcttgttggatctattgattgggttgatagaagaggaatgattgagaatgtgtttcatcgacgttcggagattttggatccacctgttgcgaacgttgatcatttgcttgttcttttctctttggatcaaccgaaacttgagccgtttactcttactaggttcttggtggaagctgaatctactcgtattccattaacacttgctttgaataaaactgaactcattagtgaagaggaattggaaacttggaagataaggttgcgtggatggaactatgaaccattgttttgtagtgtgggaactaaagatggacttgatgatattgcgtttgttctgagagatcagacttctgtgattgttggacctagtggtgttggaaagtcgagtttaatcaacgtattgaggagtaatcatggtggtggtgtggtggaagatgagaattggtttgagcctatgttaggtaataagtggtttgatgatcagcgagtaggggaagtttcgagtagaagtggtagaggtaaacatacaacacgaaatgtatcgctactgccggtttctgaaggtggttacctcgctgatactcctggctttaaccagcctagtttgctgaaagtaacgaagcattcactagctcactgttttcctgagatacggaacatgattgagagcgaaaaatgtggattcagagactgcttgcatattggggaaccaggatgtgttgtgaaaggtgactgggaaaggtatccttactacttacaattgcttgatgagatcagaatcagggaagaatttcagcttaggacttttggaaccaaaagggaagatgatgttaggtacaaggtgggagacatgggtgtgaaacatgctgaaccacggttaatgcctaagaagcataggagagagtcaaggaagaaaacgaaacagacaatgatcagtgagctggatgagttcgaagatgaagacagtgatttgtacatagagaacgacccaatcgtccaagccattgagaatgagaataaaagacaatgagagaactcaagtttccactataactaagtcacatgatgtaaaagattgtacagatctttttaagttctcagctcttttgtttgtctgaattattgactaat

SEQ ID NO: 310 - DNA, 1087 bp, Arabidopsis thaliana
ctccaactcacttctcattggataagacaactatcaagaagccttcaatttccattggtcctcctctctccttctataatcccaaaaaccatctcacaaactcatcaaacctctttctcatctcatcttcaagccatctccgatcatcatcagacaatggcagcagctatggcaacagcaaccaagtgcatgtctctaaacccatctcctcctaaactccaaaaccaaaccaaatccaaaccattcatctccctaccaaccccaccaaaaccaaacgtctctctcgccgtcacaagcaccgccctagccggagccgtcttctcttccctcagctactctgagccagctttagccatccaacagatcgctcagctcgctgcagcaaacgccagtagcgacaaccgtggcttagctcttctccttcccatcgtcccagccattgcatgggtcctttacaacatcctccagccagctattaaccaggtcaacaagatgcgtgagagtaaaggtatcgttgttggtctaggtattggtggtggtcttgcagcgtcagggcttttgactccacctccggaggcttatgctgcggcagaagcggcggctgctagttcagacagcagaggacagttgttgttgattgttgtgacaccggcactactttgggttctgtacaatatcttgcagccagctttgaaccaaatcaacaagatgaggtctggggattaaaatcttatatatatataatattattataaatcatctttgggattcaaatgtaaaattaatcctttgttttatggacagttttatgtttacatttttggactaatatcgtttctcttatcggcataagtactatactcaatttcaactgtaactaggttagtctgatgatttctagaaccacaattctagtagtgcatagcttcagcttctagccttctaggggacttggagttggtttaagtaatgcgaaacgcttcctccagtgttttagatcccagatggctttaacaggaggaatgtaccatcttttgagaaattatatcaagaacccatatctcaaaatggactttcgtacaaactc

SEQ ID NO: 311 - DNA, 458 bp, Arabidopsis thaliana
atggtgttacttggtcttctaggtgattgggaaaccaaacacgagatggaatctgttgaagatccttcaaaagagaaaccgtcatggaggatcctgaatgtcccagggaaaccacccaagttagcttggggacatagcacatgcgttgttggaggaactagagtattggtccttggtggtcacaatggtgaggaatggatactcaatgaattacatgaactctgcttggctagctggcaagactcggatctgtaaagactctttccttattcatttggtttgtggttatgtatctgtcacattccaaactcttatgacagaagcgtgtgtacatagtaaattagtgattgttgtacgctttagatattaatgtaatgatgttaatgggtttgctgtatgagatccttctataatatacttactccttgttacatgaccatgtagcatttgattttgac

SEQ ID NO: 312 - DNA, 1224 bp, Arabidopsis thaliana
ttagtttccacacgcagagagagaaacaaagagagagatgggagggagggtttgtggcagataaactgatagaaaactttcgaacctctcttctttaacttttactactctctattcgtttttctcttccttttgtggtgccgcctccaactgaaagtcttctaatatatattctcaattattctagctctccgggagaagtcttatctcacgccaatctctcatttcccactatgaggcatgaggagaattacttagacctcaacaatcttccagatgatttttctaaagatggcaataagcaagccctcgaggaaggttcttcctctggtcaaagaaagaagaaagggagtaaagaagggaaagatgagagtgggaaagtgtacgaatgtcgattttgttcactcaagttctgcaaatcccaagctcttggtggccacatgaatcgccaccgacaagagagggagaccgagacattgaatcaagctcgtcaattggtctaccgtaacgataccataaccccacctggaatttctcctttcggctatcatcataccacagatccaacaatataccggtcggtttactcatcaccaatgatatatcctggaagctcttcaacgaacttggttccgcaaccgccgatgccaccaccaccgcctccatatccatactcttcaaaccaatactctcctcacaaccacttcaacgactactacttaaacccatcttttagaggcagcagaagcatctctccaagtcctaacctccccaccaccaccaccgttgattacatggccgatagtcccgtggaaccgggctacacttgtgttggtgcacccattggtccgaccggtttccctatccgtggcccaagcatcgtccgtgcgccgcttgaaccaccacaaggtcgtgatggtgacgcttcacgacagcgtttggatcactctcttaggttccccatcaatcggtttcaagatcatcactcgctctgagttttaatagattctctacgcttttcttttcttttctttttttgtttttttttgggtattttcttgtcctcttgttttgtaactttgttggttctatctaaaagtagagatctagaattgtctaaacgccaagatcctacatgtgttattatcataatgacatgtttgttggtttttattggtctagtcgaatactctaattattcacaaccggattttgttttatgtc

SEQ ID NO: 313 - DNA, 5375 bp, Arabidopsis thaliana
gagccattgattcacaatctcaaaattcatcacagcgaagaagatgcgatcttcgtttctagtctcgaatcctccatttctaccttctctaatccctcgttacagttctagaaaatccatcagacgtagcagagaacgcttctccttccctgagtctcttcgtgtctctcttcttcatggaatccaaagaaacattgaggtcgctcaaggagttcaattcgatggtccgattatggatagagacgtgaatttggatgatgatttagtggttcaagtgtgtgtgactcgtacattgcctccagctttgactcttgagcttggtctcgagagtctcaaggaagctattgacgaattgaagactaatcctcctaagtcatctagtggagtcttacgatttcaagtggctgtgcctccaagggctaaagctttgttctggttttgctctcaaccaacgacttccgatgtgtttcctgtgtttttcctctccaaggatactgttgagccttcttataaatcactttatgtaaaggaacctcatggggtttttgggattgggaatgcattcgcttttgttcattcatcttcagttgactccaatggacatagcatgatcaaaacattcctctcagatgaatcagctatggtgacggcctatggttttccagatattgaattcaacaaatactctactgtaaatagcaaagatggctcttcttactttttcgttcctcagattgagttagatgagcacgaggaggtctctatattagcagttacattggcatggaatgaatctctctcttacacagttgagcaaacaattagttcatatgagaaatcaatttttcaggtttcttctcatttctgcccaaatgtagaggatcactggttcaaacatctaaaaagttctttagcgaagcttagtgttgaagagatacatccacttgagatggagcatatgggctttttcaccttttctgggagagatcaggctgacgtcaaggaactggtatcttctttaccctgaaaagtatacaatcatcatgtcagttccattgcaagctttcacctgacgttgttttctcaaacaacatgctgaatcgagagactgaagtgagcaacttcttgagagatgaagctaacatcaatgctgtatgggcatcagctataattgaagaatgcactcgtcttggtttgacgtacttttgtgtagcccctggatcaaggtcttcccatcttgctatcgctgctgccaaccatccccttacaacgtgtcttgcatgctttgatgaacgatctcttgcgtttcacgctattggttatgctaaaggatccctcaaaccagcagtcattataacatcatcaggaactgccgtttcaaatcttcttccagcggttgttgaagccagtgaggatttcttaccactgctactacttaccgcagatcgtcctcctgaacttcagggagttggcgcaaatcaagcaataaatcaaataaaccacttcggttcgttcgtcagattcttcttcaatcttcctcctccaaccgatcttattccagtccgaatggtccttacgactgtagactccgctctacattgggcaacaggatctgcttgtggaccagtacatctcaattgtccttttagagacccacttgacggtagtccaacaaattggtcatctaactgcttaaatggattagacatgtggatgtctaatgctgagccattcacaaaatattttcaagtacaaagccataaaagcgatggtgtaacaactggccaaattactgagatcttacaagtaatcaaagaggctaagaagggtcttcttcttattggtgcaatccatacagaggatgaaatttgggcttcgcttctgttggcgaaagagctgatgtggcctgtagttgcagatgtcttgtctggtgtacggctgcgcaagctttttaaaccttttgttgagaagttgacgcatgtttttgttgatcatcttgatcatgccttattttcagactctgtcaggaatttgatagagtttgatgttgttatccaggttggaagtcggataacaagtaaaagagtttctcagatgctagagaaatgctttccatttgcatacattttggttgataagcatccatgccgacatgacccatcacacctggtcactcacagggtccaaagcaacattgttcagtttgctaattgtgtgcttaaatctcgatttccatggaggagaagcaagttgcatggtcatctacaggcattggatggcgctattgcccgggaaatgtcatttcaaatatctgctgaaagctccctgactgaaccttacgttgcacatatgctttctaaagcactaacttctaaatctgctcttttcatcgggaatagtatgccaataagggatgtggatatgtatggatgtagttcagaaaattcttctcatgtggtagatatgatgttgagtgcagaactaccatgtcaatggatacaagtaactggaaatagaggagctagtggcattgatgggttgctcagctcggccactggctttgctgtaggatgcaagaagagagtggtctgtgtggttggggacatctctttccttcatgatacaaatggattggcgattttgaagcagaggattgcaaggaaaccaatgacaattcttgtgataaacaaccgtggaggtggaatcttccgacttcttcctattgcaaagaaaacagagcctagcgtgttaaatcaatatttctatacagcacatgacatttccattgaaaacttgtgtttggcacatggtgtgaggtatgttcacgttgggacgaaaagtgaacttgaggatgctctatttgtaccaagcgtggaggagatggattgcattgtggaggttgaaagctctataaacgctaacgcgattgttcatagcactttggagaggtttgcacgccaagccgcagaaaattccctgggcattgtttctgccagttcttttcttcatccgatgatcaaaaatgtacttctttgccaagtctctggaatacaatattcgcagtacagagtcaaactgtgtgacagacctaccatatgttctgatgaattctctcaattccatcgagaagggttcatactctccctgactttggaggatggaagcattggctatggagaggttgcacctctgaacagtaatgtagagaacttaatggatgttgaggggcagcttcagttagttcttcacctcatgaatgaagctaaatttagttacatgcttcctttgttaaatggctcgatttcttcctggatttggagtgaacttggaattactgcatcatcgattttccctagtgtcagatgtggtctggaaatggctcttctaaacgcaatggcagtaagacatgattctagtttgttggggatacttcattatcagaaagaagaaaatggttctgctcagccacactctgttcaaatatgtgcccttcttgattctgaaggtactccactggaggtcgcatacgttgctagaaaacttgttcaagaagggttcagtgctattaaacttaaagttggtcgtcgagtgagctctgttcaagatgctttagttatgcaagaagtaaggagagccgttggcgttcaaattgaactccgtgcagatgcaaattgtcgttggacttttgaagaggctagagagtttggtttattggtgaacagctgtaatttaaaatatattgaggaacctgtccagaataaagatgaccttataaggtttcatgaagaaactggattaccagtggcacttgatgagactcttgatgattttgaggaatgtcctctgcgtatgcttaccaaatatacgcaccctggaatagttgctgttgttattaaaccaagtgttgtgggagggtttgagaatgcagcactgattgctcggtgggcacagcagcatggaaagatggctgttataagtgctgcatatgaaagtggcctaggtttatcagcatatattttatttgcatcatatttggagatggagaacgtgaaagcatccacagagcagaagcaaggaacgcccccttctgtagcccatggtcttggaacttaccggtggcttagtgaagacgtaatgatgaatacattagggatatttcgtagcccttacagtggatttgttgaaggatttattgctgatgctagtagaaatctaaaggatgttaagataaacaacgatgttattgttagaaccagtaaaggaattcctgttcggaggtatgaactgagggtggatgtagatggtttctctcatttcataagagtccatgacgttggggagaatgcagaaggaagtgtagctttgtttcttcatggatttcttggaactggtgaagaatggatccccatcatgacgggtatctcaggatctgcgagatgcatttcagtcgatattcctggtcacggaaggtcaagggtacaaagtcatgctagtgagacccagacgtccccaactttctcaatggagatgatagcggaggcattgtataagttgattgagcaaattactcctgggaaagtaaccatagttggatattccatgggagcaaggatagcactgtacatggctttgaggtttagcaacaagatcgaaggagctgtcgtggtatcagggagcccgggactcaaggatccagtagcacggaaaattcgaagtgctacagatgattccaaagcacgaatgatggttgacaatggactatatatctttatcgagaattggtacaatggaggcttgtggaagagcttgagaaatcatccccattttagtaaaattgctgcaagccgcttgctacatggtgatgttcctagtgttgcaaagctcctgtctgatctaagcagtgggagacaaccgtcattgtgggaagagttggaggattgtgatacaaatatctcgctcgtattcggggagaaagatgtcaaatacaagcaaatcgctactagaatgtaccgcgagatgagtaaaagcaagaagagcgtaaacaatatcatcgagatagttgaaattccagaggctggtcacgctgtacatctcgagagccctcttcgcgtgattctcgccctcagaaaattcttaacaagagttcacaacagttctacagagacagagctttctcagaagctcttgttagcactaaaagaaatgtaaaacagatttggaacatgaagacatggttatgatcatatgattggacctgtttcaggcctttagtactgaattgtttcaaatttcaattgtattgaatactagcttcttcagagatatgttttcaagaataataattaattgattcaaatactattttaacaaaaaaa

SEQ ID NO: 314 - DNA, 1620 bp, Arabidopsis thaliana
gtggcttaaacccaaaaaaggaacatggatgttagtatgagtttttcacaagatatggataatgagtatgagaagctgataagaagaatgaatccaccaagggttgtgattgataatgactcttgcaagaaggcaactgtgataagggtggatagtgcaaatgaatatgggattcttcttgaagttgtacaaatccttactgatcttaaccttactatcactaaggcgtacatatcttctgatggtggttggtttatggatgtatttaatgtcactgatcaagatggtaacaaagtcactgatgaagttgttctagactatatccaaaagtctcttgggcctgaagcttgtttctccacttccatgagatcagttggtgtcataccatcaacagacagcacggttattgagttaactggatgtgacagaccaggtctgctgtctgaactgtcagctgttttgacccatctcaaatgcagtgtcctcaacgctgagatttggacacacaacaccagagcagctgctgtgatgcaggtcacagatgacttaaccgggtgtggcatttctgatccagagaggttgtctcggatcaagaaccttctcagaaatgtgcttaagggaagcaacacaccaagggaagctaaaaccgtagtgtctcatggggaggtccacacggataggaggcttcatcagatgatgtttgaggatagagactatgaacaccgtttggtggatgatgattcctctatccaagatgaaaggcaaagaccagatgtttgtgttgataattggctcgataaggattactctgtggtcacagttagatgtaaagacagaccaaagcttctgttcgacacagtctgcactttgactgatatgcagtatgtggttttccatggaagtgttgatactgagggcaccgaggcgtttcaggagtattatgtgagacatatagatggatcccctgtgaaatcagaggcagagaagcaaagagtcatacaatgtcttgaagcagctatcaaaagaagagtatctgagggattgaagttggaactgtgcacgacggatagagtaggcttattgtcaaacgtgactcgcatattccgtgaaaacagcctaacggtcacaagagctgaagtgaaaaccaaaggaggcaaagctctaaacacattctatgtcagtgatgcatctggttactcaatcgatgctaagaccatagattccataagacaaaccataggccaaactattctcaaagtcaagaacaaccctcaagaacaacaacaaagacagaaatcgccttctcacgaatcaccgacaagatttctctttgggggtctcttcaagtcgaaatcttttgtcaactttggcttggtccgttcctactcttgaagaacaacttcacttagctgtgaggtttcaatctcatctaggttttaactgctttaaacttgagaagaatctgtaaatctatcgccagatataatcttaaattcttggtctaggatccaactttgggtagggaaaaaaagacaaaagagttttagttgatgtcatgactaagtgttaagtgttaacctactcttcttgtatatatatcaaatcctcattatcttcttc

SEQ ID NO: 315 - DNA, 3163 bp, Arabidopsis thaliana
gcctcttttatctctctctctcataaacccacactctcttcttcttcttcttcttcttcttcttcttctctctctctttcttctgcttttccaaagctttccaaagccaacaaaggtctctctctgtagctccttttcctctcagcagccatggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtgaaggtcaaaagtttcttggaaagctatcagatgatcaagctgcaaagatcatgaaaatgggctgccaaaaacctaatgaaaggaaagctattattgataaggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctgattctttaatatataaaaaaattgatcttgatactaaaaaa

SEQ ID NO: 316 - DNA, 2020 bp, Arabidopsis thaliana
atatatccaaacaaatgaatgtgttaaaccttcactcttctctccacacaaaattcaaaaacctcacatttcacttctctcttctcgcttcttctagatctcaccggtttatctagctccggtttgattcatctccggttatggggagagaatgaggagttaccgttttagtgattatctacacatgtctgtttcattctctaacgatatggatttgttttgtggagaagactccggtgtgttttccggtgagtcaacggttgatttctcgtcttccgaggttgattcatggcctggtgattctatcgcttgttttatcgaagacgagcgtcacttcgttcctggacatgattatctctctagatttcaaactcgatctctcgatgcttccgctagagaagattccgtcgcatggattctcaaggtacaagcgtattataactttcagcctttaacggcgtacctcgccgttaactatatggatcggtttctttacgctcgtcgattaccggaaacgagtggttggccaatgcaacttttagcagtggcatgcttgtctttagctgcaaagatggaggaaattctcgttccttctctttttgattttcaggttgcaggagtgaagtatttatttgaagcaaaaactataaaaagaatggaacttcttgttctaagtgtgttagattggagactaagatcggttacaccgtttgatttcattagcttctttgcttacaagatcgatccttcgggtacctttctcgggttctttatctcccatgctacagagattatactctccaacataaaagaagcgagctttcttgagtactggccatcgagtatagctgcagccgcgattctctgtgtagcgaacgagttaccttctctatcctctgttgtcaatccccacgagagccctgagacttggtgtgacggattgagcaaagagaagatagtgagatgctatagactgatgaaagcgatggccatcgagaataaccggttaaatacaccaaaagtgatagcaaagcttcgagtgagtgtaagggcatcatcgacgttaacaaggccaagtgatgaatcctctttctcatcctcttctccttgtaaaaggagaaaattaagtggctattcatgggtaggtgatgaaacatctacctctaattaaaatttggggagtgaaagtagaggaccaaggaaacaaaacctagaagaaaaaaaaccctcttctgtttaagtagagtatattttttaacaagtacatagtaataagggagtgatgaagaaaagtaaaagtgtttattggctgagttaaagtaattaagagttttccaaccaaggggaaggaataagagttttggttacaatttcttttatggaaagggtaaaaattgggttttggggttggttggttggttgggagagacgaagctcatcattaatggctttgcagattcccaagaaagcaaaatgagtaagtgagtgtaacacacacgtgttagagaaaagatatgatcatgtgagtgtgtgtgtgtgagagagagagagaagagtatttgcattagagtcctcatcacacaggtactgatggataagacaggggagcgtttgcaaaagatttgtgagtggagatttttctgagctctttgtcttaatggatcgcagcagttcatgggacccttcctcagcttcatcatcaaacaaaaaaaaaatcaagttgcgaagtatatataatttgtttttttgtttggatttttaagatttttgattccttgtgtgtgacttcacgtgacggaggcgtgtgtctcacgtgtttgttttctcttcaaatcttttattttggcgggaaattttgtgtttttgatttctacgtattcgtggactccaaatgagttttgtcacggtgcgttttagtagcgtttgcatgcgtgtaaggtgtcacgtatgtgtatatatatgatttttttttggtttcttgaaaggttgaattttataaataaaacgtttctattatatg

SEQ ID NO: 317 - DNA, 1317 bp, Arabidopsis thaliana
gacacagttttcaattcttcagcagacagatcgatcacactccatcgattccgtatgaaaccctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagaggcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaggatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattgaagttgctcttcttttggtttctagttttggattgacccatcatttgttgtcctttcatttattttctgttgtgtaaagaattataatgctaatgagaataatacagaagaagattttggttaaagaaatgtttttaagccc

SEQ ID NO: 318 - DNA, 1820 bp, Arabidopsis thaliana
gtaatttccaaaaatgaaggctgagtctagcaacgagtctttcataatcgggcagcgagtccactctctcaacgattcgcgtcgtgtgggcaccgtgaaatacgtcggagatgtggagggatactccggaacttggatcggcgttgattgggatcaagacggtgatggaaaacataacggttccgtcaatggcgttttctactttaacggtcgttctcagagctcagcttcatttgttcgttcccagaatcttagtcgcggtatcacattgcttcaagctttggagcttagatacagaacaatttcaactaaggacgaagaagatgaaatgtatgttctctctgctgggaatagacgtgtttcgattcagcttttaggaggggataagatccaggataagttaagtcggttcgaggagcttacgagtgcttctctttcgtatcttggtgttagttctcttggagtttcatctgatttgggttcaattctaccaaatttgaagctgctggacttaactggaaacttgatttctgactgggaggagattggtgctctttgtgaacagttaccagcacttacaacccttaatttgtcttgcaattctttgtcaagtgatatcaagtctctgccacagttaaaaaatatccgtgttttggttctgaataatagtggtctgagctggactcaggttgaaattcttaggcgctcgttacctggaattgaggagttgcatctgatggggaacatgatatctaccataacatccacgtcctcatcagatgatcaagcatttaactctctgcggctactgaacttggatgataattgtatttccgattggagtgaagtattaaagctatctcaacttccatgcttggagcagctttacctgaataagaataagctttcacgcatctttcagtctgtaaatggcactgaatcatcagagaaaggcagcgacccatttcctagtctgagttgtcttcttctaggagccaacaacattggcgatttggcctcagtagacgcactgaatgggtttcctcagttagtggacatcaggctttcggaaaacccaatatctgatcctgtaagaggtggtgtcccaagatttgttctcgttgcaaggttgacaaaagtacaagtgctgaatgggagtgaggtaagagctcgtgagaagaaggattctgagatccggtatgtccgaatggtgatgtcaaagttaaatgacaagtctggggagattgagctgctccaccctagattttatgaactcaagaaacttcatggaattgaggacgaaagagcatcagctgagaacagcggccctaagaatatagcatctggacttatctccattactctcaaatgcgttggtccatcaatgggtgaaaaacctcacttgacaaagaagttaccgggcagtatcacggttggaaagctgaagatcttatctgagaactttttcaagctcaagtccatcaagccaagattatttctgcaggaagagggctcaccttttccgacagcactcgatgacgagactgcaacattacttgacgttggaatctgcgacggctccacacttcttgttgacgaagagagttaagttaaggtcatcacatactacacactcttcagaatttaaactcgatttattttatggattgtcactgtgaacattaatagtttatccatcttttgcaagtaacttgaacccacgtaaaaacattaatagttccagaaccatcatcatcattgcaaaagtttcatacaaagttaaaaaaaaattgaaattgagaagagacaacatgttttat

SEQ ID NO: 319 - DNA, 2270 bp, Arabidopsis thaliana
aacactcactttactcttttttccctcttcaccacttctctctcaaactaaagacaaaagctcttctctcttccctctctcttctccggcgaacaaaagatgattacggcggcggacttctaccacgttatgacggctatggttccgttatacgtagctatgatcctcgcttacggctctgtcaaatggtggaaaatcttcacaccagaccaatgctccggcataaaccgtttcgtcgctctcttcgccgttcctctcctctctttccacttcatcgccgctaacaacccttacgccatgaacctccgtttcctcgccgcagattctctccagaaagtcattgtcctctctctcctcttcctctggtgcaaactcagccgcaacggttctttagattggaccataactctcttctctctctcgacactccccaacactctagtcatggggatacctcttctcaaaggcatgtatggtaatttctccggcgacctcatggttcaaatcgttgttcttcagtgtatcatttggtacacactcatgctctttctctttgagtaccgtggagctaagcttttgatctccgagcagtttccagacacagcaggatctattgtttcgattcatgttgattccgacattatgtctttagatggaagacaacctttggaaactgaagctgagattaaagaagatgggaagcttcatgttactgttcgtcgttctaatgcttcaaggtctgatatttactcgagaaggtctcaaggcttatctgcgacacctagaccttcgaatctaaccaacgctgagatatattcgcttcagagttcaagaaacccaacgccacgtggctctagttttaatcatactgatttttactcgatgatggcttctggtggtggtcggaactctaactttggtcctggagaagctgtgtttggttctaaaggtcctactccgagaccttccaactacgaagaagacggtggtcctgctaaaccgacggctgctggaactgctgctggagctgggaggtttcattatcaatctggaggaagtggtggcggtggaggagcgcattatccggcgccgaacccagggatgttttcgcccaacactggcggtggtggaggcacggcggcgaaaggaaacgctccggtggttggtgggaaaagacaagacggaaacggaagagatcttcacatgtttgtgtggagctcaagtgcttcgccggtctcagatgtgttcggcggtggaggaggaaaccaccacgccgattactccaccgctacgaacgatcatcaaaaggacgttaagatctctgtacctcaggggaatagtaacgacaaccagtacgtggagagggaagagtttagtttcggtaacaaagacgatgatagcaaagtattggcaacggacggtgggaacaacataagcaacaaaacgacgcaggctaaggtgatgccaccaacaagtgtgatgacaagactcattctcattatggtttggaggaaacttattcgtaatcccaactcttactccagtttattcggcatcacctggtccctcatttccttcaagtggaacattgaaatgccagctcttatagcaaagtctatctccatactctcagatgcaggtctaggcatggctatgttcagtcttgggttgttcatggcgttaaacccaagaataatagcttgtggaaacagaagagcagcttttgcggcggctatgagatttgtcgttggacctgccgtcatgctcgttgcttcttatgccgttggcctccgtggcgtcctcctccatgttgccattatccaggcagctttgccgcaaggaatagtaccgtttgtgtttgccaaagagtataatgtgcatcctgacattcttagcactgcggtgatatttgggatgttgatcgcgttgcccataactcttctctactacattctcttgggtctatgaagagatattaccaaaacacagggactttgttttattcttttgtgggatgatgaattgtgaaaagaacaatgccctttttgttgaaaacccacaaattaaatcagaagcagctttagagaatctttgaggataattgaagctcttgaagaagagaagaagaaggagacttaagtaggagctcagcaagttttacctttttcttaattttaatgaacattcgtgtttcctcttttggtaggttttaggaatttgtaaaagctttggctacttttagtgaattaaaaacgttaaggaaaatatca

SEQ ID NO: 320 - DNA, 1648 bp, Arabidopsis thaliana
acaaactcaaaacacagagaacagagagagagagagagactccattgttgaagtgtgttcactgaactcctcctcaaacaacaatggcgacgacggttacactcaaatccttcaccggacttcgtcaatcatcaacggagcaaacaaacttcgtctctcatgtaccgtcatcactttctctccctcaacgacggacctctctccgagtaaccgcagccagagccactcccaaactctccaaccgtaaactccgtgtcgccgtcatcggtggtggaccagcaggcggggcagctgcagagactctagcacaaggaggaatcgagacgattctcatcgagcgtaagatggacaattgcaagccttgcggtggcgcgattcctctctgtatggtcggagaattcaacttgccgttggatattattgatcggagagtgacgaagatgaagatgatttcgccgtcgaacattgctgttgatattggtcgtacgcttaaggagcatgagtatataggtatggtgagaagagaagttcttgatgcttatctgagagagagagctgagaagagtggagccactgtgattaacggtctcttccttaagatggatcatccggagaattgggactcgccgtacactttgcattacactgagtacgatggtaaaactggagctacagggacgaagaaaacaatggaggttgatgctgtcattggagctgatggagctaactctagggttgctaaatctattgatgctggtgattacgactacgcaattgcatttcaggagaggattaggattcctgatgagaaaatgacttactatgaggatttagctgagatgtatgttggagatgatgtgtcgccggatttctatggttgggtgttccctaagtgcgaccatgtagctgttggaacaggtactgtgactcacaaaggtgacatcaagaagttccagctcgcgaccagaaacagagctaaggacaagattcttggagggaagatcatccgtgtggaggctcatccgattcctgaacatccgagaccacgtaggctctcgaaacgtgtggctcttgtaggtgatgctgcagggtatgtgactaaatgctctggtgaagggatctactttgctgctaagagtggaagaatgtgtgctgaagccattgtcgaaggttcacagaatggtaagaagatgattgacgaaggggacttgaggaagtacttggagaaatgggataagacatacttgcctacctacagggtacttgatgtgttgcagaaagtgttttacagatcaaatccggctagagaagcgtttgtggagatgtgtaatgatgagtatgttcagaagatgacattcgatagctatctgtacaagcgggttgcgccgggtagtcctttggaggatatcaagttggctgtgaacaccattggaagtttggttagggctaatgctctaaggagagagattgagaagcttagtgtttaagaaacaaataatgaggtctatctcctttcttcatctctatctctctttttttgtctgttagtaatctatctacactaatgttgttactcttcaatgtattcagtatcatatttatgttttctgttcattgaattagtcaaaaagcatttggctttacaatc

SEQ ID NO: 321 - DNA, 672 bp, Arabidopsis thaliana
cttcatcatcctcattctcttatccatcaatcgttacttcgtttcttctctatcaccaggaaaaaagaagaagatagctcctgaagacaaaaatggcggtttctctcccgaactcgtttcttcagattagcccatgtgttccttctctgcaattaagaaagccggtgatggcggcagtgaaaggaggaaaacaatcggtgagaagaagcagcaatacggtggttcagataacgtgtcgtaagaaggaattgcatcctgaattccacgaagacgcaaaggtttactgcaatggagagctggtgatgactacaggaggaacaaagaaagagtatgtggttgatgtatggtcaggtaaccatccgttttacctcgggaatcgttcggctttgatggttgatgctgatcaagttgagaagtttcgtaagaggttcgctgggctttctgagattatggagattcctgtgcttaaaggagaaatcattatgcctactaagaaaagtaaaggtcccaaagggaagaagaaatgatgagtcttttctggtaaagcttatgtctttgaatttgttgtcttttcaattgaagtcgagatactgcttaggctgttaaaaattgtatgtgaattttcttctgaatgctattggttatgctttctttaagatctatttggtttca

SEQ ID NO: 322 - DNA, 1055 bp, Arabidopsis thaliana
atggcactgtttcaggagaagctttcatcactttcctcaagttattcgtcaattcattctcttccgaggattctcgtgtccaagcctcgtaatagaattgccgtgacaaagtcccgttcgatttgcagagcttcgtggcaagagctcgccggagtgttggttttctcggcgattccattcactgcggttaaagcaattgcaaatagctcaataggagtttctctacggcggagattagaagagaaaaagaaggaagccgtagagaattcttcaagattcaagtctaaagctcaggaagctagaaacgacagcaagtggtatggaaaagaacgtccccgttggtttggtccaatcccatatgattatcctccataccttacaggagaacttccaggggattatggtttcgacattgcaggacttggcaaagatcgtttgacctttgataagtatttcaactttgaaatacttcatgctcgttgggccatgcttgcagcattgggtgctctaatcccggaagtatttgatctcactggaactttccattttgctgaacccgtatggtggcgagtcggttactccaagcttcagggagagacattggagtacctcggcatcccagggcttcatgtagctggaagccaaggtgtcattgtaattgccatttgccaagtactcttgatggtaggaccggaatacgcaagatactgtggcattgaggccttagagccactgggaatatacttgccaggagacattaactatcctggagggacgctttttgatcccttgaatctttccgaggatcctgtagcttttgaagatcttaaggttaaagagattaaaaatggacgattggcgatggtcgcgtggcttggattttatgcacaggctgctttcactggaaaaggtcctgtacaaaatcttgttgaccatgtctcggatccattacataacaatctgattgccatgcttcagacatgacaatgtgtgaatatatgtacatatatgtcaaaatagaaaagacaatgtgtgaaaatgtttaataccatatg

SEQ ID NO: 323 - DNA, 884 bp, Arabidopsis thaliana
aggattaaattagggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttc

SEQ ID NO: 324 - DNA, 2076 bp, Arabidopsis thaliana
aagacatcacggtctctctctataaaaacagtacctacctcttcttcttcttcttcattcgctgacttcgtttacactgaaaacaaatacctatgtcaccgccgtcggcaaccgccggtgacatcaaccaccgtgaagtagacccgacgatctggcgcgcttgtgctggagcctccgtccagatccctgtccttcactctagggtttactactttccacaaggtcacgttgagcactgttgccctctcctctctactcttccttcctccacctcgccggttccatgtatcatcacttcaattcagttgctcgccgatccggtcaccgacgaggtctttgctcaccttattcttcaaccgatgacgcagcagcagtttactccgactaattattcacgattcggcagattcgatggcgatgttgatgataacaacaaggtgactaccttcgccaaaattctcacgccttctgatgctaacaatggaggtggcttctccgttcctcgtttctgtgctgattccgtcttccctctgcttaattttcaaatcgatccaccggttcagaagctctacgtcactgatatccatggagctgtttgggatttcaggcatatctatcgcggtacaccgaggcgtcacttgctaacaacgggatggagtaagttcgtcaatagcaagaagctcatcgctggagattcggtggtgtttatgagaaaatctgcagatgagatgttcatcggcgttaggagaactccgatctcaagcagcgacggaggaagtagctattacggaggagatgagtataacggttactacagtcagagtagcgttgccaaggaagatgatgggagtccgaagaagacgtttaggagatctgggaatggtaagttgactgctgaggctgtgacggatgcgatcaatagagcgtctcagggattaccatttgaggtggtgttttatccggctgctggatggtctgagtttgttgtgagagctgaagatgttgagtcttcaatgtctatgtattggactcctgggactcgagtcaagatggctatggagactgaagattcttctcggatcacatggtttcaaggcatcgtttcctctacttatcaggagaccggtccatggcgtggatctccatggaagcagcttcagatcacatgggatgaacctgagattctgcaaaacgtgaagagggtgaatccatggcaagtggaaattgctgcacatgcaactcaactgcatacccctttccctccagcaaagaggttgaagtatccacaacccggaggagggttcttgagtggagatgatggagaaatcctttatcctcaaagtggactgtctagtgcagcagcacctgatccaagtccttctatgttctcgtattctacatttcctgctggcatgcagggagccaggcaatatgattttgggtctttcaatccaaccggattcattggaggaaatcctccccagctattcaccaataacttcttaagtccgcttcctgatttgggaaaagtgtcgactgagatgatgaactttggcagtccgccatcagataacttatcgcctaatagcaacaccactaatctgtcctctggaaatgacctggttggaaaccgaggccccctttcaaagaaagttaactcgattcagttgtttggcaagatcattaccgtggaggagcattctgagagcggtcctgcagagtctggcttgtgtgaagaggatggcagcaaagagtccagcgacaatgagacacagttgtccttatcacatgctcctccaagcgtgcctaaacattccaacagcaacgcaggttctagctcccaaggttaaaaagtgaaagaagtggtggatctttgctggaatctccaagtcctaagtagtagtagtagtactattatatataattctgttgtttctgcaattgacttttctctggcttttctttgccacgtgacgattccgttttttactttctttcttttttttttatcaatttctcagacacatttgatgaacatctcgctctcatctaatcgttaactatttttattggggt

SEQ ID NO: 325 - DNA, 1019 bp, Arabidopsis thaliana
ggaaagagcagaagaaatttgcagaagagagaaaaacaaaaatggcggttctttgctcgtcttcgacggtgatactctcttcttcttccgtgaaatcctccggaagtgagagaaagtctccgtttttagggttctctttaacggctatctcgaagccgtcggtacgagtcggcatttatgcgaattcgaaaagaggattgcaagtgaagtgtgaagctgagccgacgacgacgacttctcttgttccggcgaatcaacgatggatgttcgacgaagaagaagctaatggccctgacatctggaacacgacatggtatccaaaagcttcagaccatgtgaacacggacaagccctggtttgtggttgatgcaactgacaaaattcttggtagattggcatcgacaattgctaatcacatccgtgggaagaatcttgcctcttacactcctagtgtcgacatgggagcttttgtgattgtggtgaatgctgagaaagttgctgtatctggaaagaagcgtaaccaaaagctgtacaggaggcattcaggacgacctggtggtatgacagtagagacatttgatcaattgcagcagagaattcctgaaagaatcgttgagcatgctgttcgtggaatgcttccaaagggacggcttgggagagctctgttcaatcacctgaaggtgtacaaaggccctgaccatcctcacgaggcccagaaaccgcttgatctgcctatcagggacaagagaatacagctgcaaaaatagaagctccaccactgttccattatcgccaagcgcagagagttttttcttctcaggtttctgtagtttcttcatcccaaaaccagaggaggctttacagattcttgttttcgcttctatcaactctgttatgctacaaaactttctaatttgaaatatttctcgttatttttttttgctactgaatatcttcttcaacatgaaaaagatgacatgtaatgaatacaaatgccataagcaacagtagtcaccatt

SEQ ID NO: 326 - DNA, 1587 bp, Arabidopsis thaliana
gcattcacacaacaacaacaactaagaaatggcacgatatgaattcttccgccaaatattcattgtcttgtctatagtttctccgttggtcagatctttcactgtgatcacctccgactcgacggccccatctgctctgatcgacggcccacaaactggattcacgatgaccaatgacggcgctcgcacggagcctgacgagcaagacgccgtctacgacattatgcgtgcgaccggcaacgactgggctgccgcgattccagacgtttgccgagggagatggcacgggatcgagtgtatgccggaccaggataacgtctaccacgtggtctctctgtcgttcggagcgctctcagacgacacggcgtttccgacttgtgatccacaacgctcttacgtctctgagtccctcacgaggctcaaacacctcaaagccttgttcttctaccgatgtttaggccgcgccccacagcgcataccggcgtttctgggacgcctcggctcgagtctgcaaacgctggttctgagggagaatggttttttgggacctatccctgacgaattgggcaatctcaccaatttgaaagttcttgatttgcataaaaatcacctcaacggctccattcccttgtcgttcaaccggttctccggtttaagatcgcttgatttgagtggtaaccggttgactggttccattcccggttttgttcttccggcgctgagcgttctggatttgaaccagaatcttttaaccggaccggttccacccacactcacaagctgtggatcgttgatcaaaatcgatcttagccgaaacagagtcactggtcctatcccagaatcgattaaccggctcaaccaattagtgcttttggatttgagctataaccggttatcaggtccattcccgtcttctctccaaggcctaaactctcttcaagctttaatgctcaaaggcaacacaaaattctcaacaacgattcctgaaaacgcgttcaaagggctcaagaacttgatgattcttgttctctcgaatacgaacatccagggctcgataccgaaatcattgactcggttaaacagtcttcgggtccttcacctagagggcaataatctgaccggagagattcctttggagttccgggacgtgaagcatctaagcgagctgaggctcaacgataacagtctgacaggaccagtaccgttcgagagagacacagtgtggaggatgaggagaaagctgaggctgtataacaatgctggtttgtgtgttaaccgggacagtgacttggatgatgcattcggttcaaaatctggttcaactgtaagattgtgtgatgcagaaacgtcgagaccagctccttccggtacggtccagcacctatctagagaagaagacggtgctttgccggacggagctacggacgtgtcaagcacttccaagtctttggggttctcctatctttctgcattctttcttgtattccctaatttcatttttatgctaatatctagttagaggagggatgataaaactgctgtaaatacttcccgagtttaataatgttagttagatgccttttctgc

SEQ ID NO: 327 - DNA, 1588 bp, Arabidopsis thaliana
aacccatttactctctcgatctgcccaagctcccatcttttctgttcgtagagctcatttccccaaattaataaagaaaaaaaaaaagactttttttcttcttcttcttcttgaagaaatttctggagcgtaatcgagagttaatgtggtgctaagtcccaaacgttagaaaagggttggatcgtgtcaaagggtttcaatcatggggaaggagaatgctgtttctggaaactctataccaatccatggtcgccctgtaactcgtgctcttgcctctgctctgcgtgcttcttctaagctgataacatcttctgaagtggctgctacaacacagaaccagggacgggttcttagagcaaagagtaaaagaacagccttggatgagaagaaagccaatgcacctaagaagcgagctgttcttaaggatatcactaatgttacctgcgagaattcttacacaagttgcttcagtgttgcggtggagaatatcaagcagataaagaagggacgacagagttcttcttcttccaaggtggcatcttcttcggctacttcacaagttacagatgcaaaggtagaagttgtgtcaaattcagcaggagcaagcttgtctgtttttacagatacaagcttaggcacaaacgaaacatcctatagcattatcgcaaagccaagctccagatcgcctccaagaccctttgggacagttgagagaagttgtggtggagcaagtagcccgaaattcgttgacattgattcagatgacaaagatcctctactctgtagcctttatgcacctgacatctactacaacctgcgtgttgctgagcttaaacgaagaccatttcctgattttatggagaaaacacaaagagatgtgactgagacaatgcggggaattcttgttgattggcttgtagaggtctcagaggaatacacacttgtacctgacactctttacctcacagtgtatctcatagactggtttctccatggaaactatgtggaaagacagagacttcaattgcttggcatcacttgtatgctcattgcttcgaagtatgaggaaatccatgcgccacgcattgaggagttctgcttcatcacggataacacttatacaagagatcaggtcctggaaatggagagccaagtactcaagcattttagctttcaaatttacacccccacttcaaaaacattcctcaggagatttcttcgagcagctcaagtttctttcccgaatcaaagtctggaaatggagtttctggcgaattacctaacggaattgacgttaatggactaccctttcttgaagttccttccttcgatcatcgctgcttcggctgtttttcttgccaagtggacattaaaccaatcaagccacccttggaatccaactcttgagcattacacaacgtacaaagcctccgatctcaaagcatctgtccacgccttgcaagatttacagcttaacaccaaaggatgttccttaaactctatacgcatgaagtatagacaggacaagttcaaatccgtggcggtattcagttctggagagctaccggacaagctattcatctcctaa

SEQ ID NO: 328 - DNA, 2353 bp, Arabidopsis thaliana
aaatcattactgtacttttctctcttaacggtttctttattattcttcccattctacccctcttcttccttctaattccccctcaaatgccactgtcttctcactaaactccaaaacccaccggaaaaaatgattacgtggcacgacttgtacaccgtcctcaccgccgtggtaccactttacgtagctatgattctcgcctacggatccgtacagtggtggaagatattctcaccagaccagtgctccggcatcaaccgcttcgtcgctatcttcgccgtccctctcctctccttccacttcatctccaccaacgatccttacgccatgaatttccgcttcgtcgccgccgacacgcttcaaaaaatcatcatgctcgtcttacttgctctatgggctaacctaaccaagaacggtagcttggagtggatgatcacaatcttctctctcagcactctcccaaacactcttgtcatggggatccctctgttgatcgccatgtacggaacctacgcaggttctctaatggtccaagtcgttgttcttcagtgtatcatttggtacactctccttctcttcctcttcgagtaccgtggcgctaagcttcttattatggagcagttcccggagactggtgcgtctattgtttcgtttaaagttgaatccgacgtcgtttctctcgacggtcatgattttcttgagacggatgctgagataggaaacgacgggaagcttcatgttaccgtgaggaaatcaaacgcatcgagacggtcactgatgatgactccacggccttcgaatcttaccggagctgagatctatagtcttagttcgactccgagaggttctaactttaaccattctgatttttactctgttatggggtttcccggcgggaggctttcgaattttggtccggcggatttgtactccgttcaatcttctcgtggtccgactccacggccttcgaacttcgaagagaacaacgccgttaaatatggattttacaataacactaacagttctgttccggcggccggttcgtacccggctccgaacccggagttttcaaccggtacgggtgtttcaactaaaccgaataaaattcctaaagaaaaccaacagcaactgcaagagaaagatagcaaagcgagccatgacgctaaggagcttcacatgtttgtttggagctcaagcgcttctccggtctccgacgtgtttggcggaggtgcaggcgacaacgtggcaacggaacaatctgaacaaggtgctaaggagattcggatggttgtctctgatcaacctcgaaagagtaatgctagaggtggtggtgatgatatcggcggtcttgatagtggagagggagaaagagagatagagaaagctacagcagggctgaataaaatggggtctaattccacggcggagctagaggcggctggtggagatggcggcggcaacaacggaacacatatgccgccgacaagtgtgatgacacgactgatattgataatggtgtggagaaagctgatcagaaacccaaacacgtactccagtctaatcggtctcatatgggctcttgttgcttaccggtggcatgtggctatgcccaaaatattacaacaatccatctccatactctcagatgctggtcttggaatggctatgttcagcttaggtttattcatggcacttcaacccaaaatcattgcttgtgggaactctgtcgccacgtttgccatggcggtcagatttataaccggtccggccatcatggctgttgctgggattgccattggcttacacggcgaccttctccgtatagccatcgttcaggctgcgttgcctcaaggaatagttccgtttgtgtttgcaaaagagtacaatgtgcatcccacgattctaagcactggggtcatatttggaatgttaatagccttacctataactctggtctactatattcttcttggcctttgaattggtcccttcagtatcaactggcttttgagagagcctcggagattgggctatttatttctcggtaacgaggaaataagcaaagcctttatttttcgtgggaaagagtggaaggtgaagaagaagatatgcctttggtttttggttccaatatttgtggaacacaacaaaagtacttaggatttagtgaacaagacttgaatggattaaggatcttgtcttcattagacgccaagaagaaaaaatctctcttccttacctttattttttcattttctgtttttgttaatttatgtgtagattttggctaagcagatatgtaatatgcacctttttttattaattgaagtttctagttaagtggtttatactg

SEQ ID NO: 329 - DNA, 2552 bp, Arabidopsis thaliana
aaagtgaaagtccaacaaagatacaaagaagaagagagaagaagaagaagaatgaagctaacacataacttctcgtttcttcttcttcttcttcttgttcacatgagctcgaaacacattcttgcttctaaagattcgtcttcatatgtggtgtacttcggagctcactctcatgtcggagagataacagaagatgccatggatcgagtcaaagaaactcactacgactttcttggttccttcactggaagccgtgagagagccacagacgccattttctactcatacacaaagcacatcaacggattcgctgctcatctagaccacgaccttgcttatgaaatctccaaacaccctgaagttgtgtctgtcttcccaaacaaagctttaaagcttcacacgactcgatcatgggactttttgggtttggaacataactcttacgttccttcctcttccatttggagaaaggctaggttcggagaagataccattattgcaaatctcgatacaggtgtgtggccagaatcaaagagctttagagatgaaggcttgggaccaattccttcaagatggaagggaatatgtcaaaaccaaaaagatgccactttccattgcaataggaaactgataggagcaaggtacttcaacaagggctacgcagccgccgtaggacatctcaactcaagcttcgactctccacgtgatctcgacggccatggctcccacactctctccaccgccgccggagattttgttcctggagtcagcatcttcggccaaggcaacggcacggccaaaggtggctcccctcgcgccagagtggccgcgtacaaagtctgctggccgccagtcaaaggcaacgaatgctacgacgcagacgtcctcgctgctttcgacgctgccatacacgacggagctgacgtcatatccgtctctctaggcggcgagcctacctcgttttttaacgacagtgtcgctattggttcctttcacgccgctaagaagcggatcgtggttgtttgctctgccggaaactctggaccggcagatagtacggtttctaatgtcgcgccatggcagattaccgttggtgctagcaccatggaccgtgagtttgctagcaatcttgttctcggtaatggaaaacattacaagggacaaagcttgtcatccacggcattgccacatgctaagttctatccaattatggcatctgtaaatgcaaaagctaagaacgcttcagctttggatgcacaattatgcaaacttggatcgcttgaccctataaagacaaagggaaagatattagtgtgtctcagagggcagaacgggagggtggaaaagggtcgggccgtggctttagggggtggcatagggatggttcttgagaacacttatgtcaccgggaatgatttactcgctgacccgcatgtccttccagccacacagctcacttctaaggatagttttgctgtgtcaagatatatcagccaaaccaagaagccgattgcacacattactccttcaaggacagatttgggactaaaaccagcgcctgtaatggcttcattttcttcaaaaggtccaagcatagtggctcctcagattctgaagcctgacataactgctcctggtgtgagtgtgatcgctgcctacactggagcagtctctccaacaaacgaacagtttgatcctcgacgacttctgttcaatgctatttcaggaacctctatgtcttgtcctcatatctctggcattgcgggtcttctcaaaactcgttatccttcttggagccccgcagctatccgctctgccatcatgactaccgcaacaataatggatgacattcctggacctatccaaaatgcaaccaacatgaaggcaacacctttcagttttggggcaggacacgtccaaccaaatttagctgtgaatcccggtctcgtatacgatttaggcatcaaggattacctcaacttcttatgctcacttggatacaatgcatcacaaatctctgtattctcgggcaacaactttacttgttcaagccctaaaatcagtcttgttaacctcaactatccttccatcacagttccaaacttaacatcaagcaaagtcaccgtttcaaggactgttaaaaacgttggacgaccttcgatgtataccgtcaaggtgaataacccacagggtgtttatgtcgcggtgaagccaacgagcttgaatttcaccaaagttggagagcaaaagacgtttaaagtgatccttgtgaaaagtaagggaaatgtggctaagggctatgtgtttggagaattggtttggtcagacaagaagcatcgtgtgagaagtcccattgtggtgaagctctaactttgaatttgagtgccaattatgatatttgatctatgaagtttagttgcctatatgtttgaatttaaggcttacaaagaatggtgtaatgttgtgctgatcatataaaataatacctagactagcacccgtgctacaacacaggtttctagttcttattactgatataacgttaccgcttg

SEQ ID NO: 330 - DNA, 1953 bp, Arabidopsis thaliana
atggcctcttctcattctcttctcttttcttcttccttcctctctaaaccctcttctttcacttcttctctgagacggtttgtttaccttcccactcgccaattttggccaaggcagcgacatggtttctctaccgtcttcgccgtcgccaccgagccagctatctccagcagcggtcctaagaaagcagagccatcgacggtcgtgcttcctagtaatgaatcatctgataagcttctcaaaattcgacacacgtgtgcgcatgtaatggcaatggcagttcagaaactcttcccggatgcaaaagtgacgataggtccttggattgataatggtttctactatgattttgatatggagcctttaacagataaagaccttaagaggatcaagaaagagatggatcgtatcattagtcggaatttaccacttttaagagaagaagtatctagagaagaagcgaagaaaaggatcatggcgataaatgagccttataagatggagattttggatggtattaaggaagaacccatcaccgtttatcatatcggtaatgaatggtgggatctttgtgcgggtcctcatgtcgagaccacagggaagataaacaagaaagcagttgaactagaatctgttgctggtgcatactggagaggagatgaaaagaggcaaatgcttcagaggatatacggaacagcttgggagagcgaagagcaactgaaagcatatcttcattttaaagaagaagctaaacgcagggatcatagacgcatcggccaagaccttgatctgttttctatccaggatgaagctggaggagggttagtgttttggcatccgaaaggtgcaattgttagaaacataattgaagaatcgtggaagaaaatgcatgttgaacatggttatgatttgatctatactcctcatgttgccaaagctgacctgtggaagatcagtggtcacttggacttctacagagagaatatgtatgatcaaatggagatcgaggatgagctttatcaactccgaccaatgaattgcccttaccacatcttgctttaccaaagaaagcgtcaatcatatcgagatttgcccataagagttgcagagctcggtacagtttacagatatgagttgtctggtagcttgcacggtctcttccgtgtcagagggttcacacaggacgatgcacacatattttgtttagaggatcagatcaaagatgagatcagaggtgttctagatctcacagaagagatattgtcgaggtttggattcaacaagtatgaggttaacttatcaactagacctgaaaaatcagttggaggtgatgatatatgggagaaggcgacctgtgcccttagagatgctttagatgataagggatggagctatgaggttgacgaaggaggtggcgccttttacggcccaaagatcgaccttaagattgaagatgcattgggtagaaaatggcagtgctcaactattcaggtcgacttcaatcttcctcagagatttgacattacctatgtagacacaaactcagataagaaacgtcctataatgatccacagagcggttttaggatcattagaaagatttttcggtgttctcatagaacactacgcaggggatttcccgttatggctctctcctgttcaagtccgggtcttacctgtcacagacaatcagttggagttttgtaaggaagtgagtaagaaactgagagcttgtggagtgagggctgagttgtgccatggggagagactgcctaagctcataaggaacgcagagacgcagaagatcccgttaatggcggttgttggacccaaagaagtcgagaccggaactgttaccgttagatcgaggtttggaggagagcttggaaccattcctgttgatgacctcatcaacaaaatcaacattgcagttgaaaccagaactgctctgtaa

SEQ ID NO: 331 - DNA, 768 bp, Arabidopsis thaliana
agaatcatatttgtggctctggtttctccatccaaacaaaaacaacacccaaaccttgtccacaccaaaatgttaaactcaaaatccaaccacacacacacaatttctcttcctctctaccattaacatcgatcagaaagaccgagagagagagggagaagctgattgattatggctgctgcttcgatttctgcaataggatgtaatcaaactttgataggaacttccttctatggaggatggggaagttccatctccggagaagattaccaaaccatgctctccaagacagttgcgccaccgcaacaagccagagtctcaaggaaagcaatcagagcagttccaatgatgaagaatgtcaatgaaggcaaaggcttatttgcacctctagttgttgtcacacgcaacctagtaggcaagaagaggtttaatcagctcagaggaaaagccattgccttacactctcaggtgatcactgagttttgcaaatcgattggagcagatgcaaaacagagacaagggcttatcaggcttgctaagaagaatggagagaggcttggtttccttgcttaggtcttaaaaagaacaaatctttctctctgcttgtgtctgatatatacactcacaactcctcttgttgttcttgtctagatgtattttgtccaaacctataatcttgatttttgttacattgcctttgagggttactcaaacacacataactgctgccattctcatctgaaaagttgttcaataaggtcttagctg

SEQ ID NO: 332 - DNA, 5772 bp, Arabidopsis thaliana; identical to SEQ ID NO: 96

SEQ ID NO: 333 - DNA, 2718 bp, Arabidopsis thaliana
accatctctctcttctttcacgtctctcttccctgaaactttcccgagaaaattctcaatcctctattttctcgagaaaattctcattctcattttctttcagggaaaagttttgttgttgaatacagatttggaaacttcatttgtttttttccgtttttaaccaaaatttttaaaaaagctttcttctgaacgttaatcgtggagagtttcgggtcgggtcgggtcgtaaaaggcgggtttcacggtggtgatagattcacctcctgcttccttctgagggggttagccccgaggctcttcgcctcggcgggtttcaaattcccccaaatctaacaaactcacagattcattttctccattttttttgtttgttgaaaatttgaatccacaaattttgaattcatttgtaaccgttcgttgaagaagaagaagatgcctgctctagcttttgttgatactcccatcgataccttttccagtatctttacaccgtcgtctgtttccaccgccgttgttgacggttcctgccattggtctccgtccctctcctcctctctttaccgtatcgacggatggggagctccgtatttcgcagcgaattcctccgggaacatctctgttcgtcctcatggctcaaacactttacctcaccaagacatcgatctgatgaaagttgtgaagaaagttacagatccgagtggtttaggattacagcttccgcttattgttcgtttccctgatgttctgaagaatcgtcttgagtgtcttcaatccgcgtttgattacgcgattcagagtcaaggatatgattctcattaccaaggtgtgtatcctgtgaaatgtaatcaagatcggtttatcatcgaagatattgtcgaattcggatccggttttcgattcggtttagaagctggttccaagcctgagattcttcttgctatgagttgtttgtgtaaaggtaatcctgaagcttttcttgtgtgtaatggttttaaagactctgagtatatctcattggctttgtttgggaggaaacttgaattgaatactgttattgttcttgagcaagaagaagagcttgatttggttattgatttgagccagaagatgaatgttaggcctgttattgggttaagagctaagcttagaactaaacattctggtcattttggttctacttctggtgagaaggggaagtttggtttgactacggttcagattcttcgtgtggtgaggaagctgagtcaagttggtatgcttgattgtctccagcttctgcattttcacattggttcacagattccgtccacggctttgctttccgacggtgtggctgaggctgcgcagctttactgtgagcttgtccgtcttggtgctcatatgaaggtgattgatattggtggtgggttggggattgattacgacgggtctaaatcgggggagtcggatctctctgttgcttatagtctcgaggagtatgctgcagctgttgtggcttcggttaggtttgtttgtgatcagaagtctgtgaagcatccggtgatttgcagcgagagcggtcgagccattgtgtctcatcactcggtgttgatctttgaagctgtctcagctggtcaacaacatgagacccctactgatcatcagtttatgcttgaagggtactctgaggaagttcgaggtgattacgagaatctttatggtgctgctatgcgtggtgatcgtgaaagctgcttgctttatgttgatcagctgaagcagagatgtgttgaagggttcaaagaaggttccttgggcattgaacagttagctggtgttgatggattatgcgagtgggtgattaaggcgattggtgcatcggatccggttcttacttaccatgtcaatctatcggttttcacttcgattcctgatttctgggggattgatcagctgtttcctattgttccaatccataaacttgaccaaaggcctgccgcgagagggatcttatcggatttgacgtgtgacagcgacggaaagatcaacaagttcataggcggagaatcgagcttgccattgcacgagatggacaacaatggctgcagcggtgggcggtactatttgggaatgttcctaggtggagcttatgaggaagctctcggtggagtccacaatctgttcggtggaccaagcgtggttcgcgtattgcagagcgatggacctcacggattcgcagtgacccgtgctgtgatgggccaatcctctgcagatgtcctcagagcaatgcagcatgagcctgagctcatgtttcagactcttaaacaccgagccgaggagccgaggaacaacaacaacaaagcttgtggtgataaggggaacgacaaactagtagtcgcatcgtgtcttgctaagtcattcaacaacatgccttatctttccatggaaacgtcaacaaacgctctcaccgcagcggtcaataaccttggcgtttactactgcgatgaagctgcagctggtggcggcggcaagggcaaagatgagaattggtcttatttcggttgattgagagagacttgacaacatcctctgtctttgatcttcaccgtacgattgattacgatcctagttcttatttgtctttaagttcagttttaaagttttaagttattttcttgtaataagacaaactcttagcaaaatttaataatattatcatttatcatcattcactaaatt

SEQ ID NO: 334 - DNA, 1612 bp, Arabidopsis thaliana
ctcttcttcttctactctctttgtgggtttctcttgtaataatcacaaaccaaaaaaaaaaatggttaactcatgcgagaacaaaatcttcgttaaacccacttcaacgacgattcttcaagatgaaacaagaagtagaaaattcggacaagagatgaagagggagaagagaagagtgttgcgtgtgattaaccagaatctcgctggtgcaagagtttatccttgtgttgtcaacaagagaggaagcttattgtctaataagcaagaagaagaagaaggatgtcaaaagaagaagtttgattctttgcgtccttcagttacaagatctggagttgaggaagagactaacaagaagctgaagccctcagttccaagtgctaacgacttcggtgattgtatatttattgatgaggaggaagctacattggaccttccaatgccaatgtcgcttgagaaaccatacattgaagctgatccaatggaagaagttgagatggaggatgtaacagtggaagaaccgatcgtggatatcgatgtcttagactcgaagaactcgcttgcggctgttgaatatgttcaagatctttacgcattttacagaacaatggagagatttagttgtgttccagtagactatatgatgcaacaaatcgacttaaacgagaagatgagagcaatactaatcgactggttaatcgaggtacatgacaagtttgatctgataaacgagacactgtttctgacagtgaatctgatagatagattcttgtccaagcaaaatgttatgagaaagaagcttcagcttgtagggttagtagctttgctgttagcttgtaagtatgaggaggtttcggttcctgttgtcgaagatttagtactcatttcggacaaagcgtatacgaggaacgatgttctagagatggagaaaacaatgttgagtactttgcaattcaatatctcgttaccgacacaatacccgttcttgaaaagattcctcaaggcagctcaagcagacaagaagtgtgaggtcttggcgtcgttcttgatcgagcttgcccttgtggagtacgagatgcttcggtttccaccatcattactagctgccacatctgtgtacactgctcaatgtacacttgatggttccaggaaatggaacagtacatgtgaattccattgtcattactctgaagaccagctcatggaatgttcacggaagctggtgagtctgcatcagagggcggcgacaggaaacttaacaggagtatataggaagtacagcacaagcaaatttggttacatagcaaaatgtgaagctgcacactttctagtgtctgagtctcatcattcttaatccaaaaggacagtagtaagtagtttgtacagcttcctgacatagttccctcattcactctgtagcacaaataagaagaaacaaaaaaaaaagccaattaaatttgtcttatgattgattctgtttttttgttgttactctttgttcacttcacttgtcagtattaaactctacaatgaatgataaatgattgaatcatttcattctttgttcagaatgaaatgtattttgtatcttatttgagctaaatacaaaaacaac

SEQ ID NO: 335 - DNA, 970 bp, Arabidopsis thaliana
agttggatctcaaaaccctaatatctgaacttcgccgtcgagagcatccatgggtcgtgtcatcagagctcaacgtaagggtgcgggttccgtcttcaaatcccacactcaccaccgcaaaggtccggctaagttccgtagcctcgatttcggcgagagaaatggttacctcaagggcgtcgtgacggagatcatccacgatcctggtcgtggtgctcctcttgctcgtgtcactttccgtcatcctttccgtttcaagaaacaaaaggagctcttcgtcgccgccgaaggtatgtacaccggtcagttcttgtactgcggtaagaaagctactctcgtcgttggaaatgttctccctcttagatctattcctgaaggagctgttgtctgcaacgtcgagcatcacgtcggtgatcgtggtgtcctcgctagagcttctggtgattacgccattgttatcgctcacaaccctgacagcgacactactaggattaagttgccatcgggttcgaagaagattgtcccaagtggatgcagggctatgattggacaagttgctggaggtggaagaactgagaagccgatgctcaaggcaggaaacgcgtaccacaagtaccgtgtgaagaggaactcatggcctaaggttcgtggtgtggctatgaatccagtggagcatcctcatggaggaggtaaccatcagcacattggtcacgccagtactgttaggcgtgatgcacctcctggacagaaggttggtcttattgctgcaaggaggactggtcgtctcagaggtcaagctgctgcttcagctgccaaggcagactagagttaaaagagataaactttgtttctcttgttttctatgtttcaagttttgttgtctgtgtttccttttgaacctcattctgaaatcctaaaagatttttatgataaacctttctctcttctcgaaaagcttatgttattcaca

SEQ ID NO: 336 - DNA, 2881 bp, Arabidopsis thaliana
tatccgcgaccgcgagatgatcttgaagaggtgtttgctttatgaatgacgatgaatcggctctgttttcctgtttccaacggttgtaatcacaccatcatcgttgtcttcatctatactaatattcaaatggtcaattataaagcccaataagctaactaagcccaaaaatgaaaacacacggactcagcccatacaaattttaacacttaaggctaatgggtctgtcacgtgcggaatagactgaaaacagagcatcgcacgtgccgcatcaaaatttgaaatcacgacgacttcaaaaaaatcccaaatggtaagaaaaaaataaaaagttgcagaaaaaacagaaaaccctcttttctctctcttctctctctctcgaggaagaaaggcaacaactatggaagctatgcttgtggactgtgtaaacaacagtcttcgtcattttgtctacaaaaatgctattttcatgtgcgagcgtctctgcgctgagtttccttctgaggttaatttgcagctattagccaccagctacctgcagaataatcaagcttacagtgcatatcatctgctaaagggaacacaaatggctcagtcccgatacttgttcgcattatcatgcttccagatggaccttctcaatgaagctgaatctgcactctgccctgttaatgaacctggtgcggagatcccaaatggtgcagcaggccattaccttcttggacttatttacaagtatactgatagaaggaagaatgctgctcaacaatttaaacagtccttgacaatagaccctctactttgggctgcatatgaggaattatgtatattaggtgctgctgaggaagcaactgcagtttttggtgaaacagctgctctctccattcaaaagcagtatatgcaacaactgtcaacttccctcggcttaaacacttacaacgaggaacgtaattcaacttctactaaaaacacgagttctgaagattatagtccaaggcagtctaaacacacacaaagccatggccttaaagatatctccggaaatttccattctcatggagttaatggaggtgtttcgaacatgtcattctataatacgccttcgccagtggctgcacagctatccggtatagctccaccaccacttttccggaattttcagccagctgttgcaaacccaaactcccttattactgacagttctccaaagtccactgttaactctactcttcaagcacctagaagaaagtttgtagatgaaggaaagttacgtaagatttctggcagactattttctgattctggtccacgacggagttcaagactgtctgctgattcaggggcaaacattaattcaagtgttgcaacagtaagcggaaatgtgaacaacgcttccaagtatttgggaggttctaaattgagttctttggcacttcgttctgtaacacttcggaagggacactcctgggcaaatgaaaacatggatgaaggggtccgtggggaaccttttgatgattcaaggcctaatactgcctcaacgactggttctatggcttccaatgatcaagaagacgaaacaatgtcgattggtggcatagcaatgagttctcaaacaatcacaattggtgtttcggaaattttaaacctccttaggacactcggagaagggtgtagactttcatacatgtacaggtgtcaggaggcactggatacgtatatgaaacttccacataagcattataatacaggatgggttctttcccaggtcgggaaagcatactttgaactaattgactatttagaggctgaaaaggcattccgtcttgcccgtctggcttctccttattgcttagaaggaatggatatatactctacggtcctctatcatttgaaggaagacatgaagctgagttacttggctcaggaactaatatcaaccgatcgcttagctcctcaatcttggtgtgctatgggaaattgctatagcttgcaaaaggaccatgagaccgcactgaagaatttcctacgagctgttcaactgaatccaagatttgcatatgcacataccttatgtggccacgaatacacaactcttgaggattttgagaacggaatgaaaagttaccaaaacgcacttcgtgtagatacaagacactacaacgcatggtacgggcttggaatgatatatctacgccaagagaagttagagttctcagagcatcacttcagaatggctttcctaataaacccgagttcctctgttataatgtcttatttagggacatctttgcatgccttgaagagaagtgaggaagcactagagataatggagcaagccatagtagcagatagaaaaaaccctcttccaatgtaccagaaagctaacatacttgtctgcttagaaagattagatgaagctctagaagttcttgaggagctcaaagagtatgcgccttcagagagcagcgtttacgctttaatgggcaggatctataagcggcgaaacatgcacgataaagccatgcttcatttcggtctagctttagatatgaaaccgcctgcaactgacgttgctgcaataaaggctgcaatggagaaattgcatgttccagatgagatcgatgagagcccgtgaaaccatagctactccaagaaccttgggtatgaattaatgtgagaccgttgctgctccacgaaccatgggtatgaattatttagtgcaaagcctacctcttttagggaactagttgggtttgaatgtagttttgttaccaaaccgtaacacagccacaagagcccacatgacttgagtatgtatcatgagttgatctgtatgttgtccgtaacactacctaatcgcaatatatgatttttccacatc

SEQ ID NO: 337 - DNA, 2037 bp, Arabidopsis thaliana
atgcttctccactgcaacgttagctactacacctcaacgttttccttcatctcctcatctctccgccgtcaagacaacgccgacgattcacaagatacagtaatccgtcgccgccacaatgctagatccatttctctatacatccgccataatcgagacctaaagctcaacaaaaaccctaacgaatctcaagaaacctttgttcctcctcctcctcctccgcggcgagatttagacggtgaaaaccgatccaagctacttgagctctctcttgtaactagaagaactccacaatttcctggttcaatctacgctcaatctgcttctgatgctgatattgcttcttctcttccttcgcttcgtaattttctcggctctgatggtgatgatgatggagagagtgagagggagatgatagttaaagcgcttgagattagaaggaaagtgacgaaagagattatcaaagagtctttggttaggaaaggtagatttgggattacgtatgcgactaatgtcactgatcgtttgggtgatttcgttgatcatgttatgattcaagctgcggcgttgaaacggttgccggaattttcagagtctagattcaatcttcgcgctaggacggttattgaagactccaatttcgttcctcttgtaaggtggttgaagcaccatgagttgtcatataatagaatagcgaagatcatatgcatgtcaaaaggaaatctcgactccataaggatcatgatcgagtggctgaagagcattcatgtgaagggtgaattcattgcagttgcgttcttgagatctggggataatatattgcaacgtaaccgtgaggaactaaacgaaattgttgagtatctagagagcaatggtgtgaggagggattggatgggttatgtggttggaagatgtcctgagttgctgtctttcagcatggaagaagtgaaaagccgtgttgatttcttcttgaaaatgggtatgaatcagaatgactttggcactatggtctatgattatccaaagataattggcttcttctcattccaagtgatggagaaaaagatcaattacctgaaagagtttggccttagcacagaagaagttgggagactattagcctacaagccacacctaatgggatgcagtattgaagaaagatggaagcctctagtcaaatatttctactaccttggaatccccaaagaaggaatgaaaagaatccttgtcgtgaaaccaattctttactgcattgatttggagaagacgatcgccccaaaggtaagatttttgcaggagatgggtatccctaatgaagccattggaaacatgttagtaaagtttccttctttacttacaaatagcctctacaagaaaatccgacctgtggtgatttttctcttaaccagagccggagtaacccaaaaggatatcggtaaagttatagcaatggatccagctctccttggatgcagcatagggacgaagctagaacccaacatgagatactatatatcattgggaattcgattttatcaactaggcgaaatgattgctgatttcccgatgctgcttcggtataacgttgataatctgcgcccaaaataccgttacttgcgaagaacaatgatccgtccgcttcaagatctcatagagtttcccagattttttagctactcactagagcgtcggataatcccaaggcacaccattatggttgagaacagagttaacttcaagctcagatacatgttggcttgtacggatgaagagtttgagaggagagtgagagataaagtggagagaagagagagattcgaagctggcctcgactctgaggattctcaaccgtcggatgagaacatctccgatcaggagattgctttctcagacgaagcggaagaagaagaggatttgacagaatgaagaggatttagcataatgaatagttctgtacagtttaacacaattataaacgaacgaatgtgtgaatgagtctatatttataaatactaaaatgagaatacttgttctttc

SEQ ID NO: 338 - DNA, 1838 bp, Arabidopsis thaliana
caaagcgattacctcccatgggaaaaatctctgaagtgattatttagcactactttttctttgtctccttctgaatccattttttatggatcttggagttcgtgtttctggtcatgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtgaaactgaaaaaaaaaaactaaggacaattgcgaaaacaaaaacactctgtttttctctgtttctggtttttcttacttgatgcattgttgtttctgttgctgttttctttctatataaagcaagaagaaactaaaggagagatgtgtgtttttttcttcat

SEQ ID NO: 339 - DNA, 1105 bp, Arabidopsis thaliana
aaaacacacacaaaacaaaatggtgctacttctccgatatcgatccttaacgataaatctcactcctctaatacccaaatctcaaaaattccacactctccaatcatttcgtaaccctaatttcatctccatcccaaaaatctcagcctccacgaacaatccaacaacaacaacgaatcggtcgatctccgacgcgactaaattcgctaagtcagtgttattcatacctcctggtgtagagattgaggaactaacagatgatatggttcttccgggttcaaatatcgtaatcggaccttttgcgggtcattcacaaatcaaagaagttgaatttgttaaaagtagtgctcgtgctagagattgtcctaaagatgatcgtcctgagattgcgattttgggtcgttctaatgttggcaagtcttcgcttatcaattgtttggttcgtaagaaagaagttgctcttacttctaagaaacctgggaagactcagcttataaatcacttcttggtgaataagagttggtacattgtggatttgcctggttatggatttgctaaagtttcagatgctgcgaaaacagattggtctgcgtttactaaaggttacttcttgaatagagacagtcttgtttgtgttctacttctcatcgatgcaagtgttcctcctcagaagattgatcttgattgtgctaattggcttggtcgcaacaatgtaccgatgactttcgtgtttacgaaatgcgataaaatgaaagcaacgaaagggaaaagacctgatgagaacattaaagctttccaacaaatcattagagagaattttaaagtacatcctccttggattttgacgagtagtgtatctggtttaggcagagacgagcttcttcttcacatgtcgcagctgagaaactactgggatcaataggtagcgcgtaaatttcgtaaacaaatgttcgaaaaggtcggttttgaatcattggttatatcaaattgtagttttgtaatgtaacagtaacttttgtatttaaagataagatcataaagtgttactactacagttctaattctgatgaaacaaattcatgaattgccgaaaaattggcaagaa

SEQ ID NO: 340 - DNA, 950 bp, Arabidopsis thaliana
aaattcatcatctttctttcttcttcttcctcatcctctcaatcatatctctctctctcacagagattgtgacttcacgcacacgtaacctaaatcgaagatggtgagaaaatatagaaaagctaaaggaattgtagaagctggagtttcgtcaacgtatatgcagctacggagccggagaattgtttatgttagatcggaaaaatcaagctctgtctccgtcgtcggtgataatggagtttcgtcgtcttgtagtggaagcaatgaatataagaagaaagaattaatacatctggaggaggaagataaagatggtgacactgaaacgtcgacgtatcgacggggtacgaagaggaagctttttgaaaatctgagagaggaggagaaagaagaattaagtaaatccatggagaattattcatcggaatttgaatcggcggttaaagaatcgttagattgttgttgtagcgggaggaaaacgatggaggagacggtgacggcggaggaggaggagaaggcgaaattgatgacggagatgccaacggaatcggaaattgaagatttttttgtggaagctgagaaacaactcaaagaaaaattcaagaagaagtacaatttcgatttcgagaaggagaagccattagaaggacgttacgaatgggtaaagttagagtgaagaagaagaagaagtttatggttttttttttaactttttagattttaatatttcagggaataagttaattttattttgttgatttggaaatataagatttgtaggaggaatgtttttagaagtacgaaattgcacagaaaaagaagaaagctttttaacagattttagagcccagaaaagtcgtgtcttttagctctacttttacctcttcttcgaatcttgtgtatcttttagcatattctttagtacatttttatgtttttggtgactgata

SEQ ID NO: 341 - DNA, 6694 bp, Arabidopsis thaliana
atgagtttgagattgcaaaaccctttcctttctactcctctgcttcatggttctttcaatcgcagagagaagagaatcaatgtagctagaagggcgtttcgtagcaagcgtatatattcggagaagaaacagaatgattggttagctaaagttgccaaattttctcaattttgtgggaaaaatgtgcaattgcttaggaagtctcttgattctagaagtagaatggaagttaaatgtttgaaagagcctttcgtacgaagcaaggatttggttaggtctttggctcctgtttgggaagagggtttgtttttcttgaggtgttctgtgttctttgctgttatctctggggtttgtttattggtgtggtatggacagaacaaggctcgtgtttttgttgagactaagcttttgccatctgtttgctctgtgcttagtgagactattcagcgtgaggttgattttggaaaggttagaagagtttcaccattgtgcattacacttgaagcaagctccattggtcctcatggtgaagagttttcctgtggtgaggttccgactatgaaagtttgtgtccgtccttttgctagtcttaggaggggaaagattgtggttgatgcgattctaagtaatccaacagttttggttgcacaaaagaaagattttacatggttagggatacctctatctgacactactttgccaagccatttgtcatctgaagaagggattgattttcgcaccaaaactaggagagtttcaagggaggaagcagggatccgttgggatgaagaaagggataatgatgcaagaaaagctgcagagataggctatatcgttccttgtaagaattactctcaagctaaagataatgcggtgaagcacgacaggcgttttacggaaattgcaaatcccaactcctttatttgcatggatgaaaagatgcattcagctgagcaacattgcatggacccaggtgttgagtatgatgtgaagcatgctgaattggagaaatcatttggcataaaaattcctggttcagggctcaagttcttgtccaaaatgttaaaagtcccgaggaagtacaaattcaaatggaattcaaaatcacataagaattcaatgtctaatattagtgcaaagaagagaattcttgagcgcagtgcttcagcagctctatcttatttccacagtctatcacaacaaaagcttgacgagccttcagtgttatcaacaaattatgatgggttgagtttggatatgctattagttaaaggtgatagagaaatcagtaatcaatatgatcgacatgtgccgtatggtgagcaatcattagctaatgatttggacgggaaaggttatcgagtgaggggtaaaaggctccttggtgtaaaaaaggcttccacgttagacaagttcacagtatcatgtgatccattccttatgactgttgatagactctgtgcactcttacaaactaaacgaagcccatctgttgaagatattgtgaattcttctgaatctgagactttaagcagtcagagaggggatatatctatgaatgttgttaatcagaatactgacgatgttccacatggtaatcgaagtggaaatcagcctcgtgactttacgttcaaaaagcatgagcatcaacctgtagcaaaccattggcgtcccagctggccacggaacaaaaaattaaaagaagcagtgtttaatattttaactggttcctctaagaagttaacaggaagggcagatccgaatgctcctcacttgagcgatgaactggagaagctgcctgctgtttatgttgagaagacactaccagttatgcttgactctgtgcagtttaaaggtgggacacttcttctattagcttatggcgatacagagcccagagaaatgaggaacgtccatggacatgttaagtttcagaatcattatggtcgtgtgtacgtgcaacttggtggaaactgtaatatgtggagatcagatgtaacatctgaagatggtgggcttttgtctgttgatgtttttgttgataccgtcgagcagaactggcatgcaaatttaaatgttgccaacttctttgtcccggttcatctatgtatgtctagaggagaaagttttccaaacctacatggccaacttgacgtaacaggactaggcttccatataaatgatgcaccttcttcgttttctgatgtctcagccagcctttctttccgcggccagcgcattttcctgcataacgctaatggttggtttggaaaggttcctttggaggcttctggagatttcggtatacatccagatgagggggagtttcatctgatgtgtcaggttccctatgtggaaattaatgctttgatgaaaactttcaagatgaagcccttgtttttcccgctagctggttctgtcacagctgtattcaactgtcaaggcccgcttgatgctcccgtttttgtgggaagttgcatggtctctaggaagatagcttatctgtctccagatctccctacatctttggcatatgaggcaatgctgaaaaacaaggaagctggtgcagttgcagcatttgaccgtgttccattttcttatctttctgctaatttcacatttaacactgacaactgtgttgctgatttatatggtattagagctacccttgttgatggtggggagattcgaggagcagggaatgcttggatctgtccagagggggaggtggatgataccgcactggatgtgaacttttcaggaaatatatcttttgataaggttttgcatcgttatatgcctgaatattttaacatcgggatgctgaagttgggtgatttaactggggaaacaaaactttctggggccctcttgaaaccgaggtttgacataaaatgggcagcccctaaagctgatggctccttgactgatgctcggggagatattgtgatatcacatgataatatcattgttaattcatcctctgttgcttttgatctattcacaaaattagatacctcataccatgacccttgtttgtcgcaccaagacttcactcaaggggaggccatgccatttgttgttgaggggcttgatttggatttacgtatgcgtggttttgagtttttcagcttggtctcttcctatccatttgattcaccacgacctacacatttaaaagcaacaggaaggatcaaatttctggggaagataaaacgacacagcactacaaaagatggagatgttgggtcagacaaatgtgaagatgcagctgcaatttctagcctcgatggtgatatttccatttcaagtctcaagcttaatcagttgattttggcccctcaactgtctggacgtttgagcgtttcacgtgatcatgttaagcttgatgccgcgggccgaccagatgaaagtcttacactagactttataggtccactacagcctaattctgacgaaaatgtacaaagtggaaagttgctctccttttctcttcaaaagggacaactaagagctaacgcttgttttcagccacaacagtccgctactttggagatacgcaattttccacttgatgagttggagttggcctcactgagagggttgattcaaaaggcagagattcaactaaatcttcagaagcgaagagggcatggcctgttgtctgtaattcggccaaagtttagtggagttctaggtgaagctttagatgttgcagtaagatggagcggtgacgtgtgtttcatgttgtccggaagactagaggttatgatcactgttgagaaaactattctggaacaaagcaatagccggtatgagcttcaaggtgaatatgtattgccgggttcccgtgaccgagaccttggtcagaaggaagctggcagttttttaatgagagccatgactggtcatctaggaagtgttatatcctccatgggaagatggagaatgagacttgaagtgcctaaggcagaggttgctgagatgcttcctcttgcaaggcttctttcaagaagtacagatccagctgttcactcaagatcaaaggatcttttcatccaaagcgttcaaaatctctgtctacaagctgaaaatcttcgagacttgcttgaggagatacgtgggtattatactccaccaagtgaagtcgttcttgaagatctaagtcttccaggtttagctgagctcaagggtcattggcatggttcgcttgatgctagtggtggaggcaatggagacactttggccgaatttgacttccatggagatgattgggagtgggggacttacaaaacacagcgtgttctggctactggttcgtataacaatgatgatggtttacgtcttaaggagatgctcattcaaaaaggaaacgctacactgcacgcagatgggaccttattggggccaaaaacaaatcttcattttgctgttctgaatttccctgttagtttgatacctaccttggttgaggttgttgaatcatcagctactgatattgttcactctttgaggaaactcttgtcaccaatcaaaggcattttgcacatggaaggggatcttagagggagtcttgaaaaaccagaatgtgatgtacaagttaggttattggatggtgctgttggtggtatagaccttggacgagctgaagtttttgcttctcttacatctaacagtcgttttcttttcaactccaactttgaaccatttgtccaaaatggtcatgtccatatacaaggaagtgttcctgttagcttttcgcagaaaaatatgtctgaaggagaagtcagcgaaacagatagaggtggtgcagtgaaaatcccgagttgggcaaaagagaaggaagatgatgagaagagaacctcaagggataggagcgaagagagatgggacagccaactagctgagagtctcaagggtttatactggaatattttagatgcaggagaagttagactggaggcagacatcaaggatgggggaatgactttgttaacagccatatctccttatgctaattggctccaaggaaatgctgatatcaggcttcaggtcggaggtacagtagaccatccagtgcttgatgggtctgcttcattccacagggcgtctatctcttcacctgtgcttcgtaaaccgctcacaaactttggtggaaccttacatgttaaatcaaacaggttgtgcatcacctcactggaaagcagggtaagtagaaagggaaagctggttgttaaaggaaatcttccccttagatcaaatgaagcatctgctggtgatggaatagagctcaaatgtgaagttctagaagtacgagcaaagaattttttaagttgtcaggttgatactcagctgcaaattactggatcaatgttgcagccaactatatcaggaaatattaaattaagccaaggagaagcttatctgcctcatgataagggtggtggagctgcccctttaaatagattggcagccaatcagtatagtattccaggtgctgctattaatcaagcagtttcttcacgatattttgctcgattttttggcactgaacgggcttcttcagggatgaaattctctcagtcgactggtaaatcaaattctgttgaaaaggagattgaagaagtgaaaatgaaaccaaatatggatatccgtctgagtgatatgaaacttgttttaggaccagagctgaggataatgtaccctttaattcttaattttgctgttagtggtgagcttgaacttgatggcatggctcatccaaaatttatcaaaccaaagggtgtcctaacattcgaaaacggagatgtcaatcttgtggctactcaggtacgtctgaagagggagcatctcaacgttgcaaagtttgagcctgaacatggactagatcctctgctagatttagccttagttggttcagaatggcaatttagggttcaaagtcgtgccagtaattggcaggacaaacttgtcgtgacttcaacacgttctgttgaacaggatgctctctcaccttcggaggctgcaaaggtgtttgagagccaattagcagaatccatattagaaggagatggacaacttgctttcaaaaaacttgcaaccgcaacacttggaaccataatgccaaggatagaaggaaaaggagagtttggtcaggcgagatggaggttggtgtatgctccgcagatcccaagtttactctctgttgatccaactgtggatcctctcaagtctctggcgagcaacatatcatttggaacggaagttgaagtgcagctcggaaaacgtcttcaggcctctgtggtaagacagatgaaagattctgagatggcaatgcaatggacacttatttaccagctcacgagccgcttgcgtgtccttctgcaatctgcaccttccaaacgtttgctttttgaatactctgctacatcacaagactaaatccttttgtcttcctctgtcggattcatatggatataagccgtttgttgcaaaggaagtgcattttggaatagcatggttttggtgactaccgacaagaaaaattattttattatttggtcagtctttctttgtgcacttcttctggccttttagtggttaaaaatgtaaaaattacattgtaaatgccttttgttagggaatgcatataaaatgttttgccacttcattgactgattggtgcaacaagaaa

SEQ ID NO: 342 - DNA, 1527 bp, Arabidopsis thaliana
aaaaaccaatccttcctttgcttataaaccccaatcttcttcttcgagagagagagtgaaagagaagaaaacgacaatgggacacgccacgagtctctctcacttcctcatcctctcttcctccaggttctctcgtctcgggtctctcactagattactctccaaacccacctctctctccggctctttttcttccatttcggtcaccggacaagggttccgatgctgttgctccgtcgccacagatgacacttctccttctgtaaagaaacgtgtggtctctggtgtccagcctacaggttcagttcacttaggcaactatctcggggctatcaaaaactgggtcgctcttcaggatacatatgaaacactctttatcatcgtagaccatcacgcgataacacttccatatgatacacgtcaactaggaaaggcaacaacggataccgcagcactttatctagcatgtggtatagacgtctctaaggcttcagtatttgtgcaatctcacgttcccgctcatgtcgagttaatgtggcttttatgttcatccacacctattgggtggttacagaaaatgattcagttcaaagagaaatcacgcaaggagggggttgagaatgctagtgtcggtttgtttacttatcctgatctgatgactgctgatatcctcttgtatcagtctgattttgtccctgttggtgaggaccagaagcagcacatagaacttgcccgtgaaattgcacagcgtgtgaatcatttatatggtggaaagaagtggaagaagcttggagggtatgaaattttccgcggtggttcgctctttaagataccagaaccactcataccacaagctggagctcgtgttatgtctcttactgatggtctttccaagatgtccaagtctgccccttctgatcagtcccggattaatctccttgactcaaaagatttgattgtggacaagataaaacggtgcaagacagactcatttgctgggcttgaatttgacaatgctgagagacctgaatgcaacaatctcctctcaatatatcagattgtttcaggcaagaaaaaagaggaagtgatggaggaatgcaaagatatgagctggggtacatttaagcctctccttgcagatgctttgatcgaacatctgagtccaatccaggcccgttatcaggagataatagcggaaccagagtatttggacaaaatattgtcagaaggtgcggatagagccgaggagttgggagctgtcacaatgcgcaatatgtatcaagctatgggatactatcagaggaggagatactgagatagtagtgcctattgatatttgttgccggcatttttgaagttacaagaaaagagtagagagttgcactttgcgaaatatttattaattcttgagttattattgattataatcttttgcaataaccgcgatctctcaaagtttatcactatgtaactgagatagtgccaatttgttacagaataaacacaagtaagaattcgttcatcact

SEQ ID NO: 343 - DNA, 1608 bp, Arabidopsis thaliana
accattcgcaatttcacagtcgagaaaaaaaagttagggttttatttgttgttcctgagagaagcgaaagagatttttgattcagagagagtggcgtctggttgggttgaagccgggacgggaaagagtcgtctccgggatttcttttcttctttgttaacgagtcttggaggagcgttacttcagatcaccgaagaagaccaacaacaaggttcagatattatggcgtcttctagagtctctgatcttcctcatcaacgtggaatcgcaggtgaaatcaaaccgaagaatgttgcaggacatggaagacaaaaccggaaagttcttggagacattggtaatcttgtcactggtcgtgatgttgcaacaggaaaggatgttgcgaagaaggcgaaacaaccacagcagcagacaaaagctgaggttattgtcattagccctgatgaaaacgagaaatgcaaaccacattttagcagaagaactcatataagaggaaccaagacttttaccgcaaccttaagagctcgaagcaaggctgcgagtggactgaaggatgctgtgatcgacattgatgctgtggatgctaacaatgaactggctgctgtggaatacgtagaggacatcttcaagttttataggactgtggaagaggaaggagggattaaagactatataggatcacaacctgagataaacgagaagatgagatcgattctgatagattggcttgtagatgttcacaggaagtttgagttgatgccagagacgctatacttaaccattaacctcgttgatcggtttctatctttgacaatggttcatagaagagagcttcagctgttgggactaggtgctatgcttatagcttgcaagtatgaggagatttgggctcctgaggttaatgatttcgtctgtatttcggacaatgcctataacaggaaacaggttttggctatggagaaatcgatcttaggacaagttgaatggtacatcactgttccaactccttatgtgttccttgcgcgatacgttaaagctgcggttccatgtgatgctgagatggagaaattggtgttctacttggctgagctgggacttatgcagtatcctatagttgtcttaaaccgtccatcgatgctggctgcatcagcggtttatgctgcgcgtcagatccttaagaagacgccattttggactgagaccttgaaacatcacactggctactcggaagatgagattatggagcatgcgaaaatgctgatgaagttaagggactcggcttcagagagtaagctaatagcagtgttcaagaaatactctgtctcagaaaacgctgaagttgctcttcttccttcgcttgacgacttctctgtttcttgtgcatgaagaaacaaaaccctagtctgcttttgttgatcatgtagctgtcatgatctctttgtgttctttctttcttttttctttttttggtttttacattgatcctctgtatgatcccgtcaaagataatgatgttaaccatgaacaagtttttaagtgtggtttcatttatcttcagtttccttggattcctcaaattacgttttggaatttttaactctttttgtc

SEQ ID NO: 344 - DNA, 2286 bp, Arabidopsis thaliana
atgagagtcccactaatagatttcttgagattcttagtactcattctttctcttagtggtgcttcagttgctgcagatgcaacggtgaagcaaaactttaataagtatgagactgatagtggtcacgcacatccgccaccaatttatggtgccccacccagctacacaacaccaccaccaccaatttacagtcctcccatatatccaccaccaatacaaaagcctccgacttatagtcctcccatatatccaccaccaatacaaaaacctcccaccccaacttatagtcctcccatatatccaccaccaatacaaaagcccccgacaccaacttacagtcctcccatttatccaccaccaatacaaaagcctccgaccccaacttatagtcctcccatatatccaccaccaatacaaaagcctccgacaccaagttatagtcctcctgttaaaccacctccggtacaaatgcctcctacaccaacttatagtccccctataaaaccaccaccagtacataagcctccgacaccaacttacagcccccctataaaaccaccagtgcataagcctccgacaccaatttacagtcctccaatcaagccaccaccagtgcacaagcctccgacaccaatttatagtcctccgatcaaaccaccaccagtgcacaagcctccaacaccaacttatagtcccccggtcaagccaccgccagtgcataaacctccaacaccaatatatagtcctccaatcaagccaccaccagtgcacaagcctccaacaccaatttacagtccccctgttaaaccaccacctgtgcaaacgcctccaacaccaatatacagtcctcctgtaaagccaccaccagtgcataagcctccaacaccgacttacagccctccagtaaaatcacctcccgttcagaagcctcctacccctacttatagtcctccgattaagccaccaccagtgcaaaagcctccaacaccaacttatagtccaccaattaaaccgccaccagtgaagcctccaactccaatatacagtccacctgtgaagccaccaccagtacataagcctcctacaccaatttatagcccacctgtcaagccaccaccagtgcataagcctccaacaccaatttacagccctccagtaaaaccacctcccattcagaagcctcctacccctacttatagtcctccgattaagccaccaccacttcaaaagcctccaacaccaacttatagtccaccaattaaactgccaccagtgaagcctccaactccaatatacagtccacctgtgaagccaccaccagtacataagcctcctacaccaatttatagtccacctgtcaagccaccaccagtgcataagcctccaacaccaacttatagtccaccaattaaacccccaccagtgaagcccccaacacccacatacagtccacctgttcagccaccaccagtgcaaaaaccgccaacaccgacttatagtccacctgtcaagccaccgccaatacaaaaaccaccgacgccgacttacagtccacctattaaaccaccaccagtgaagcctccgacaccaacatatagtcctccaatcaagccaccaccagttcataagcctccgacaccaacttacagtccacctatcaagccacctccaattcataaacctccgacaccaacttacagtccacctatcaagccaccaccagtgcataagcctccgacaccaacttacagtccacctatcaagccaccaccagtgcataagcctccgacaccaacttacagtccacctatcaagccaccaccagtgcataagcctccgacaccaacttacagtccacctatcaagccaccaccagtgcataagcctccgacaccaacatacagtcctcctatcaagccaccaccagttcataagcctccgacaccaacatacagtccacctatcaagccaccaccagtgcaaaagcctcctaccccaacttatagccctccagtaaagccaccaccagtacaattgcctccaaccccaacttatagccctcccgtaaaaccaccaccagtacaagtgcctccaaccccaacttatagccctcccgtaaaaccaccaccagtacaagtacctccaacaccaacttatagccctcccataaaaccaccaccggtacaagtgcctccaacaccaactactccatcacctccccaaggtggatacggtactcctcctccatatgcatatctatcgcatcctatagacataaggaactag

SEQ ID NO: 345 - DNA, 586 bp, Arabidopsis thaliana
ataattacatatctaccccaaaccactttattctcctttcactatcttccccaaatttcaaacgatcagattacagattcttcaattcctctttcccttctcctccatttcctgattaaggcttcacatctctgagagagaaatgggtcagatccaatactccgagaaatacttcgatgacactttcgaatacaggcacgtcgttcttcctcctgaagtcgctaaacttcttccaaagaatcgtcttctctccgaaaacgaatggcgagcgataggagtgcagcaaagccgcggatgggtacattacgcggttcatcgacctgagccgcacataatgctattcaggaggcctcttaactatcagcagcagcaggagaatcaagctcagaacatgcttgttaagtgaatcattatcatcacctgagtaagaatgttatatgcaacaattctatgagtattggtttatgtttcttgtaaacatggtttgaatctttgtggttatggatgaatatgtgagagttggtttgttgaacaacttctatgtaatgttagtcttggttctaatgtcatcttctgcttcttaatt

SEQ ID NO: 346 - DNA, 573 bp, Arabidopsis thaliana
aaaattcatttcgtttccgatcgcacttcttctcaagtaaatttaatagacgtttgttgggtgatttaagaagatgggtcagatccagtactccgacaaatatttcgatgatactttcgaatacaggcacgttgtacttcctccggaagttgctaagcttttacctaagaatcgtattctttcggaaagtgaatggagagccatcggagtgcagcaaagtcgtggatgggttcattacgcgattcatcgtcctgagccacatatcatgctctttaggaggcctcttaactaccagcaggagcaccaagctcagattgctaagtagaagaattatgcaaaattctccctaatctctgtttatgtctctcgtaaacgaggttttaaaatactactctgatgttttgttcctgtagttttttttattgtgttcatgaattctcttcagtggagaatcatgtgagtttggtagaacaacttttaatgttatgttaagtctggtcctttgctagactttggttggatccacgtttgaacttcttcatggttaagaatgaagacgttatttctcatgct

SEQ ID NO: 347 - DNA, 2120 bp, Arabidopsis thaliana
aaagaatcttctggatcctttttctctcagctactctctccatttatctaataaaccctaacccctcctcccacactattcgtttacactaaccacttccttatccacaccaatccagaacgttcctcaaaaagctccctccttttctctcaaaatggcgtctgcaaacgctctctcttccgcctccgtcctctgttcttcccgtcagagtaagttgggaggaggaaatcagcagcaaggtcagagagttagctacaacaagaggacaatcagacgttttagtgttagagctaatgtaaaggaaatagcttttgaccagcactctagagctgctctacaagctggtattgataagcttgctgattgtgttggtctcactcttggccctagagggaggaatgttgtgttggatgaatttggaagtcctaaggttgtgaatgatggagtcaccattgctagagctattgagttacctaatgccatggaaaatgctggtgcagcgcttattcgtgaggttgcgagtaagactaatgactctgctggtgatgggacaaccactgcgtctatccttgctcgggagataatcaaacatggattgttgagcgtcacttctggtgcgaatcccgtttcactcaagaggggaattgataagactgttcaaggtctgatcgaagagcttcagaagaaagctaggcccgtgaaaggtcgtgatgacatcagagctgtggcttctatctctgctggaaatgatgaccttatagggtcaatgattgctgatgccatcgacaaagttggacctgatggtgttttgtccattgaatcttcatcttcttttgagaccacggtcgaagttgaagaagggatggagattgacagaggttacatctcgcctcagtttgttacaaaccctgagaaactactagctgagtttgagaatgctagggtattgatcactgatcagaagatcactgcgatcaaagacatcatccctattttggagaagaccactcagcttcgtgctccgttgttgattattgcagaggatgttactggtgaagccttagctacccttgtcgtgaacaagcttcgtggtgtcctcaatgttgttgccgttaaagcgccaggatttggagaaagaagaaaagccatgcttcaagatattgcaatcttgacaggagctgagtacctagccatggacatgagcttactggttgaaaacgcaaccatagatcaattgggtattgcccgaaaagtcacgattagcaaagattcgactaccctcattgcagatgcagcttccaaggacgaattacaagctcggattgctcagctgaagaaagaactattcgagactgattctgtgtatgactcagagaagctcgctgagagaattgcgaagctatctggaggtgttgctgtcattaaagtcggagcagcaactgaaactgagcttgaggaccgtaagcttcgtatcgaggatgcaaagaacgcaacatttgctgctatcgaggaaggcatagttccaggtggtggtgctgctttggtgcatctctccactgttattcccgccattaaggagacttttgaggatgctgatgaacgtttgggagctgacatagtacaaaaggcattgctgtcaccagctgctcttattgctcagaacgctggagttgaaggagaagttgttgtggaaaagattatgttcagcgattgggagaatgggtacaacgcaatgactgatacatatgagaatctgttcgaagctggagtgattgatccggctaaagtgacaagatgtgcgctacagaacgctgcttccgtagcaggaatggtactgaccactcaggccattgttgttgacaaaccgaaacccaaggctcctgctgctgctgctcctgagggtctcatggtgtaatcaaaacacaacatcttatcatcacaatggcatctttgtctttttgcacatttgtcatccccatttatctgcaatgtttttcttttttgggggaatatgagtagtttgttaacagtatcgagaaataattatcatcttttttgtccaatggaaattgcagaaaatggttatgtatgcgaccaaacattttatatgtagcgagagt

SEQ ID NO: 348 - DNA, 1712 bp, Arabidopsis thaliana
aacaaacacacacaactcataactataactatacattcatacatataacaataattcacttaaatcactcggaataatgcaaatctcatcttcatcgtcttcaaatttcttctcttctctttatgctgatgaaccggcactaatcacattaacaattgttgtagtagtagtagtgttactatttaaatggtggttgcactggaaagagcaaagactacggctacctcctggctccatggggttgccttacatcggagagacactccgcctctacacagaaaatcccaattccttcttcgccactcgccaaaacaagtacggggatatattcaagacgcacatattaggatgtccatgtgtgatgataagtagtccagaggcggctcgaatggtgttagtgagcaaagctcacttgttcaagccaacttatcctccaagcaaagagcgtatgattggaccagaggctcttttcttccaccaaggtccataccattctacccttaagcggctggtccagtcttctttcatgccttctgctctcagaccaaccgtctctcacatcgagctccttgtcctccaaaccctttcctcttggacgtcccaaaagtccatcaacaccctcgaatacatgaaacgatatgcattcgatgtggcgatcatgtcagcgttcggggacaaagaggagcccactacgattgatgttattaagcttctctatcaacgtctcgaaaggggttacaactccatgcctctcgacctaccgggcacactttttcataagtccatgaaggcaagaatagaattaagcgaggaactaaggaaagtaatagagaagagaagagagaatgggagagaagaaggaggactattgggagtacttctgggagcaaaggatcaaaaacgcaacggcttaagtgattcacagattgctgacaacatcatcggtgttatattcgccgccaccgacaccaccgcttctgtcttaacttggcttctcaagtacttacacgaccaccccaatctcctccaagaagtctccagggagcaattcagcattcgacagaaaataaaaaaagaaaaccgaagaatctcatgggaagatacaagaaaaatgccactgaccactagggtgatacaagagacactaagagcagcaagtgtactgtcctttacatttagagaagcagtacaagacgtcgaatatgatggctacttgatcccaaagggttggaaggttcttcctcttttccggcgaatccatcactcctccgaattcttccccgatcctgaaaaattcgatccttctagattcgaggtggcaccaaaaccttacacgtacatgccattcggaaatggagtgcactcatgtccaggaagtgagctggctaaacttgagatgcttatcctccttcaccacctcactacttccttcagatgggaagtgattggagatgaagaaggtatacagtatggtcctttccctgtacccaagaagggtttaccaataagagtaaccccgatttaagcctaaggcatatttgggattttttttactagtccaataagtcatctttaatttctcttagtagagatttttttcttcttaaactttaaaattggcctccaatttggcccctttttcttttgtaatttttttttatcttaatgtaaagctgcaatttaatcaatctcatttttattgctttggactt

SEQ ID NO: 349 - DNA, 2337 bp, Arabidopsis thaliana
cactattctcctctctttctctccatcctccatatttgcagagctcgagattctccttccctatacaactctcatctgtaatcgatacagatggcagcttcatcagcttgtcttgtgggaaatggtttgtcagtgaacacaacaaccaaacagaggttaagtaaacatttttccggcagacagacaagcttttcttcagtgattaggacatctaaggttaatgtagtgaaggcttctttggatgggaagaagaagcaagaaggaagaagagattttctcaaaatcttgttaggaaatgctggggtcggtttggttgcaagtgggaaagcaaatgctgatgaacaaggtgtttcttcgtcgaggatgtcgtattctaggtttctagagtacttggataaggatagggtgaataaagttgatttgtatgagaatgggactatagctattgtggaagctgtttctcctgaattgggtaaccgggttgagagagtacgtgttcagctaccgggtttaagtcaagagcttctacagaagcttagggctaagaatattgattttgcagcacataatgctcaggaagatcaaggttctgtgttattcaacttgattggtaatcttgctttcccggcgcttttgattggtggtttgttccttctttcgagacggtctggtggtggaatgggtggacctggtggtcctggtaacccacttcagtttggtcagtccaaagcaaagttccaaatggaacctaacactggtgtaacatttgatgatgttgctggagttgatgaagcaaagcaagatttcatggaagtggtggagtttttgaagaaacctgagagattcactgcggttggtgccaagatcccgaaaggtgttcttcttattggtcctcctggtaccgggaaaacccttttggcaaaagccattgctggtgaagctggtgtgcctttcttctccatctctggttctgagtttgttgagatgtttgtcggtgttggtgcctcgagagtccgtgatcttttcaagaaagccaaggagaacgctccttgcattgtctttgtagatgaaatagatgctgttggtaggcaaagaggaaccggaattggtggaggtaatgatgaaagagaacagaccctcaatcagctcctaactgagatggatggttttgaaggtaacactggtgttatcgtagttgctgcaaccaatagagcagacattcttgactctgctttgttgaggccaggacggtttgaccggcaggtaagtgttgacgttcctgacgttaaggggagaacagatattctcaaggttcatgccggcaataagaagttcgacaatgatgtttcacttgaaataatagcaatgagaacacctggatttagcggagcagatctcgctaacctcttgaatgaggctgctatattggccggaaggcgagcacggacatcgatatcatctaaagagattgatgactccattgatagaatcgttgctggcatggaaggaacagtgatgaccgatggcaagagcaaaagcttggtagcttaccatgaagttggtcatgcagtgtgtggaacattgactccaggacatgatgctgtgcaaaaggtaacgttgataccaagaggccaagcaagaggtctgacttggttcattccatcagatgacccgacactcatctccaagcagcaactctttgcaagaattgttggtggactcggtggtagggccgctgaagaaatcatctttggtgattccgaggtgactactggcgcagttggtgacttacaacagatcaccggtttggctagacagatggtaacaacatttggaatgtctgatattggaccatggtctttgatggattcttcggcacaaagcgatgtcatcatgagaatgatggcaagaaactccatgtctgagaagcttgcagaagacattgattctgcggtgaagaaactatcagacagtgcatatgagatagctctaagccacataaagaacaatcgtgaagccatggataagctcgttgaagtgcttctcgagaaagaaactattggcggtgacgaattcagggcaattctttccgagtttactgagatccccccggaaaaccgagttccttcttcaacaacgacaactccagcatcagcaccaacaccagctgctgtctaagtaatcaatctgtatacttgtgatacttataatttttctgtaaatttatcttcaaacttacactctagaaatgtgatactatctcaaaatttagtaacaagtaaatgtttaaaaaattgaatttgtaggcttgtttatgatattgtccagatttgcaac

SEQ ID NO: 350 - DNA, 3106 bp, Arabidopsis thaliana
ctccctctttcgctgcaagcagagaaaaagacgacggagaaattttaaatctgaggttcttttagtcctcgcgaagccagatgctactctctattgcacgtctgtgacagaagagctcgattagggaactgaagacaaagacacggagaaattttgaactcgagaggtttgattttgaacctttgaatctctgggtttctgatttcttcgagatttaactaggtagttgaattgaatcctgataccaccttgaagcgtttttgttgtgctttctcagattatccatgatcatgtgatgcactaatttcgtagtattcaattgctgggattctgaaattagcaaaccttaaaatggttgatttgtggaaatttgtctaaccggttaatcggttaacagagttggaactagtgttatggatgatgaagatgtagaaatagatcttctaacaaaaagtagtaatgtggatgtattttgtgaagcaagtacaagtgggaacgttgctcagtgtgcaacggttagtgagctcagaaatgggatggattttgagtcaaaggaagctgcatactatttctacagagaatatgctcgatcagtgggatttggtatcacaataaaagctagccgtcgttctaaaagatcagggaagtttattgatgtcaaaatagcgtgttcgagatttggaaccaagcgcgagaaagccacagctatcaatccacgttcatgtccaaagaccggttgcaaagccggtttgcatatgaagaggaaggaagatgagaaatgggttatatataattttgtaaaagaacataaccatgagatatgtcctgatgatttttatgttagcgtacgaggaaagaacaagcctgctggtgcgctagcaataaagaaaggtcttcaattggctttagaagaggaagacttaaagctattgcttgagcattttatggagatgcaggataagcagcctggttttttctatgcggtagatttcgatagtgacaaacgtgttagaaatgtgttttggcttgatgcgaaggctaagcatgactattgcagcttttctgatgttgttctgttcgacacattttatgttaggaacggatacagaatcccatttgctccttttattggggtcagccatcaccgtcaatacgttctgcttggatgtgctttgattggagaagtgagtgagtcaacatattcttggctatttagaacgtggcttaaagcagtcggtggtcaagctcctggagtgatgataacagatcaggataagcttctaagtgatattgttgttgaagtctttccagatgttcgtcatattttctgtttgtggagtgtgctgagcaaaatttctgagatgctgaatccatttgtgagtcaagatgatggttttatggaaagtttcggaaattgcgtagcaagctcttggacagatgaacattttgaaaggaggtggtcaaatatgattggtaaatttgaacttaacgagaatgagtgggttcagttgttgtttagagatcgtaaaaaatgggttccacattattttcatggaatttgtttagctggactgtctggacctgaaagatctggcagtatcgcctctcatttcgacaagtatatgaactcggaggctacattcaaggacttctttgagctctacatgaagtttctgcaatatcgatgtgatgtggaagctaaggatgatcttgaatatcagagcaaacagcctacactgaggtcttctttggctttcgagaaacagctttccttgatctacacggacgctgcttttaagaagttccaagctgaggtacccggagttgtttcttgtcaacttcaaaaagaaagagaagatgggacaacagcaatattccgcattgaagatttcgaggaacgacaaaatttcttcgttgctttgaacaacgagttgttggatgcgtgttgctcttgtcatttatttgagtaccagggattcctatgcaaacatgcgatacttgtacttcaaagcgctgatgtttcccgcgttccgtctcagtatatattgaagcgctggtcaaagaaaggtaacaacaaagaagacaaaaacgataaatgtgccactatagataaccgaatggcacgttttgatgatctatgtaggcgctttgtcaagctgggagtagttgcatctttatcagatgaagcctgcaaaactgctttaaagttattggaggaaaccgtgaagcattgtgttagtatggataattcttccaagtttccttcagagccagacaagttaatgacaggtggatctattggcttagaaaacgaaggtgtgttggactgtgcatcaaaagtgtccaagaaaaagaaaattcagaagaaaagaaaggtatactgtgggccagaggatgcaacaaacaggtcagaagaacttcgccaagaaaccgaacaagttagctccagagctcctacgtttgagaattgttacattcctcaagcaaatatggaagagcccgaactaggctcccgtgcaacaactcttggggtctattattcaacacaacaaactaatcaaggattcccatcgatttcttccatccagaatggttactatggacatccgccaaccatacaagctatgggaaacttgcattctattcatgaacgaatgagtcaatacgagacacaaccaagcatgcaaggagctggacagacggggtttaggggaagcgctatccgtggctgctatgacatcgaagaaactctgcacgacatgacaatggggtcctcacagtttcagggatctgattcgagccatcctagtgatcaccgcttatccaattaacagaacagaacaagctcaagagttgctactttcatatctttaaaatagtggaatgttttgtatgtacagaaataggaaaggtctaaagtgtggaactggctttgagacttgtagttaccattcaaaagtcatggacaaccttcgttaaccttgagggccactgagagacaaccttggacttggtcactggctcacttagcaatattcagttattcactctgttgtatataactcaccaattaaattcaaacaactaattcaaaacattatactat

SEQ ID NO: 351 - DNA, 2016 bp, Arabidopsis thaliana
atggatgaatccttaactccaaaccctaagcaaaagccagcttcaacgacgactcgaatccaggctccgacgagtcccttcttcttgggatctaacgatgacagattggaacgggaacaagctcgagccgcaagagccgctgctagccgtcgtaggtctgtcattttcgctcgtgggtctcagcctgagacggagtctgatccttgtttcgacaaacagcaaattctcgagttgtttcagaactgtatcaaattagccagtgaaaacaaaatcaatcaaaagaatacatgggagttgaatttgatcgaccatctttgtgagattatcaaagttgaagatgagaacaatacagaaacaaattttcaaaaggcaagttgcactcttgaagctggagttaagatttactcaatgcgggtagactctgttcattcagaggcatacaaggtcttgggtggaattacccgagctggccatgatgacggtggagatcacgaggatgctgctggtgccgtagaaaatgcaactaaccaaaagaagcagccagagaaaaagatatcgcctttatcaacactggaaccttcctttgatgcccttaacgtgaagaaatttgatgtggcatttgcagtggatcccctttatcatcagacttcagcacagtttgatgaaggtggagcaaagggcctgctgctaaacaatttaggagtctatggagggtgtcaagttctatttgattcacaagaaatccctggaaagcttgtttcgtctgcaaataagcatgacaaatcagaaacaattgatctatcctttgttaaagaatgtgtggagcaaatggtgctaaacatgcgaaagaaggatgagattgtaccatctcttcgggctataatcaatcaatttgatgaagagaaccaaagaccatctgacacgttttcttgtggtcagcagacgaccgagtcatttgatatttcacatggtaatgatgctagctatgccgacgatgatgaaggatatgagaactttggaacttcttttgattatgagggtcaatccggtgatgttgatgaaaactttggccccaatgaagcagaaccaatatattcaaattttcatgaggaagttgaaccagcctccctgcaagacatggattcagatgacagactggagaatgttgatgactatctctttttgtcgttgggaatttcatctaagcaaaattcttgggcaggtcctgatcactggaagtatcgaaaaacaaaaggtccagatgttcaacctgcttcagaaattaaatcctctccaccagcgaagaaaaccaggaaaaagaagcaagcagagcctgaactagattttgcaaaagctttggaggaagaaatgcctgatatttttgcccctccaaaaaacccaaagactttacttctcccagcaagtagaaccccttgtcaaacgaagcttccagaggattgccattatcaacctgagaatctaataaagctatttctactaccgaatgtgatgtgccttgggaggaggagaagaaaaaactcaggtgaaacttcaagacagcagcctgatgattatgaacatggggaatcctggggaaatgataatgtttatgatgatgatgatggcccattcgatgataatgaaaatgatcaaagtgatgcagaggataccaacacattaatctctcagccacgccaggtcaacaaaattgatgtccaatacgataaagcttcaaaacaagttgatgtgcaagtgctaaaggaaactctttgggagtgtcttcaggaatctcatcaacctccaattcaggatgaggaacatcaacaagaaccacctgaaagtagatctttcaaagtgctattggctagcttcccagatgattgccaagcagccgagagaacccaagacatctcaccacatctatgtttcatctgcttgctgcatttggcgaacgagcacaatctcagcctcattggttctcaaaacttggatgatctaacaatacaccttgcctga

SEQ ID NO: 352 - DNA, 1045 bp, Arabidopsis thaliana
taaaataagccaaactttacctctccattttcaataatctctcatcttctttcgtctctctttctacggttcaaacattaaaaagatagatggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatataacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatagattaacaaacttgggaacaacttctattaactttaataaattagattatgattgtttccaaagttaattatgcaatccaggagtctttcttggttttggtaattaatagccatattttatagcttatctaattgtatcaaatattgaaaactggt

SEQ ID NO: 353 - DNA, 981 bp, Arabidopsis thaliana
caaccacaaaataaaccggggtggtgtcatagcatcgacattaacttaaaactacaaaatagagctgggtcctcgtcaggttttaaggatacatatgtatgcatgtatgcatatacaaaataatagagcactaaagcttgttcgtactcttttttacacaacatgctaataatttttataccttaggagtgaaattttagtggtccaacaacttaagcacctaagatccttccccacttttgtttggggctcctttatatctcttccaatggttacttttacttcctcttcttctcttcttgttccatctttcatgtgagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcacaactgactaaagacggtgaaacgtgtgagatcccggtttgaaggttaatgaaacaggctttgcttactctcttctgtcagtctcttttagctccttgtaatcctctgtgtctctgtctgtttctccatattacctgtaatcaaagctatctgctaaacctacgacatggttaaataaatgcattgagacttagtaaatgcttgaagaaattatgtgtaataactctttaaacttgtcaaatgttatttcaagcc

SEQ ID NO: 354 - DNA, 1045 bp, Arabidopsis thaliana
aatcactctcaccagtcacaaccaaaaaaaagaaaacacaaaaacaaagattataatggcttcctcaaccatggctttgtcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggtgagttccccggtgactacggatgggacaccgctggtctatccgccgacccagagaccttcgccaggaaccgtgagctagaagttatccacagcagatgggccatgctcggagccctaggctgcgttttccctgagctattggctaggaacggagtgaagttcggagaagcggtttggttcaaggccggttcacagatcttcagcgacggaggattggactacttgggcaacccgagcttggtccacgctcagagcatcttagccatttgggctactcaagttatcctcatgggagctgttgaaggctacagagtcgccggagatggtccattgggagaagcagaggacttgctttacccaggtggcagcttcgacccattgggcctcgctactgaccccgaggctttcgcagagttgaaggtgaaggagctcaagaacggaaggttggctatgttctctatgtttggattcttcgttcaagccatcgtcaccggaaagggacctttggagaacctcgccgaccatttggccgacccagtcaacaacaacgcttgggccttcgccaccaacttcgtccccggaaagtgagcggctgcttattatgtgaatgagagcagagaaagagagtttgtttgtggtctattctatgtaaatttgtgaactttcctttgtggtatctttgtatagaaatcgaacctctttttctctaactgtgttggcgttttatctgaagactcaattgaattgaaatatccactcttgtaaaattcatatgttctg

SEQ ID NO: 355 - DNA, 1008 bp, Arabidopsis thaliana
atccaatttcatcacatcttattaactaaagagccttttacttgcgccacactctcaccgcaatggccgcctcgacaatggctctctcctctcctgctttgaccggaaaggccgttaagctatccccggcggcctccgaagtatttggaaccggccgaatcaccatgcgcaaagcctccaagcccaccggtccatccggcagcccatggtacggatccgaccgagtcaagtacttgggtccattctccggtgagcctccgagctacctcactggagagttccccggtgattacgggtgggacactgccggtctatccgccgatcccgagaccttcgctaggaaccgtgagctagaagttatccacagcagatgggccatgctcggagccctaggctgcgttttccctgagctattggctaggaacggagtgaagttcggagaagcggtttggttcaaggctggttcacagatcttcagcgacggaggattggactacttgggcaacccgagcttggtccacgctcagagcatcttagccatttgggctactcaagttatcctcatgggagctgttgagggctacagagtcgccggagatggtccattgggagaagcagaggacttgctttacccaggtgggagcttcgacccattgggcctcgctactgaccccgaggctttcgcggagttgaaggtgaaggagctcaagaacggaaggttggctatgttctctatgtttggattcttcgttcaggccattgtcaccggaaagggaccgttggagaacctcgcggaccacttggctgatccagtcaacaacaatgcatgggccttcgctaccaacttcgtccccggaaagtgagtttaatttgtgatcgagttgtgtgtatccggtttgttgcatcttggaaatgtgatgcagatttcatatcttgtaaattactttgtatgtgtgtgaaatatttaagaagctttatgatattgatggatcagtcacttactattta

SEQ ID NO: 356 - DNA, 1722 bp, Arabidopsis thaliana
aaaactccaacacttctccttcttccatctctctcaaacttctgaaaatcttcttcttcttctcaatcataaaccctaaatcttcatctcttcagatcagaaactaatgtccattcaaagacaccctgtcctgtttcatctctgtcattagtcttctgttttcagattccaattttttttcttgaattatcctcttagccatttcttgatttaacttcgattttcccggcgatgttacgagaatcagacggtgagatgagtttaggaacaacaaactcaccgataagcagcggaacagagagttgcagcagtttcagccggttatcattcgacgcgccgccgtcaactatccccgaagaagaaagcttcctttctctcaaacctcaccgatcctcagatttcgcttacgcagagatccgaagacgaaaaaaacaaggcctaaccttccgagattttcgcctcatgcgtcgtatcggcgccggcgacatcggaacagtttacttatgccgtctagccggagacgaagaagagagccggagctcgtattttgcgatgaaagttgtggataaagaagctcttgcgttgaagaagaagatgcatagagcagagatggagaaaacgattttgaaaatgcttgaccatccatttttgccgactctttacgctgagtttgaagcctcacatttctcttgcatcgttatggaatattgctccggtggtgatttacactctctccgtcatagacaacctcaccggcgattctccctctcttccgccagattttatgccgccgaagttctagtggcgttagaatatctacacatgttgggtatcatctacagagatctgaagcctgaaaatatcttagttagatccgacggtcacattatgctctctgactttgacctctctctatgctccgactcaatcgcagccgttgaatcttcctcgtcttcgccggagaatcaacaactccgttcaccgcgacgattcactcgtctcgctagacttttccaacgagtcttgcggtctaaaaaggttcagactttagaaccaacccgtctctttgttgctgaaccggttactgcccggtccggttcgttcgttggtacgcatgaatacgtggcaccagaagttgcttcaggtggatcacatggtaatgccgttgactggtgggcctttggagtgtttctctacgagatgatatatggcaagactccgttcgttgcgccgactaatgacgtcattctccgtaacattgtgaaaagacagttgagtttcccgactgattcgccggcgactatgtttgagcttcatgcgcggaatttgatttccgggttgcttaacaaagatccgactaaaagacttgggtcacggcgaggtgcggcggaggttaaagtgcatccttttttcaaaggtctaaactttgcgctcattcgtacgcttactccgccggagattccttcttccgtcgtcaagaagccgatgaaatcggcgacgtttagtggtagaagtagtaacaaaccagcggcgttcgattacttttgaacgttttctacggtcgagattagggccacgtgttagtctgttttagctgtacatattccctcgaagctgtcctttttttcgttctttaatttttaaaatttcgttaatctgacttataaattaaaaatttaggtgacttttcatacaatttgtacaacaaacggattaatctaa

SEQ ID NO: 357 - DNA, 963 bp, Arabidopsis thaliana
gatttggtcgcaccaaagatcggatttttatcagacggaaaggaggagacggaagaaaatgccggtgagagttgttgagagcaacacgcctgctcaagtttcaggaactgatcctgggaatcgatcaccacttccccctagttcacttctcggcgctggccaggcattttctggtacgcaaaatgtctctaatcaacagaaggaggaagcttggagagtcaacgtccagatacagggtattgaccttgaacatggttatctttgtggcaccatggaagctctaaacgttcccatggcagacactcctgtcataacattctgggaaggggaaatcgttgatggaaagaattataccttttacaccggaaaatgggaagcaacgagggaagatgatatgagacattggtcaaagttcccgtctttttcgcctcttcagggacaagttgaatctgatggtggcaggcaattggatcttaacaattatccttatatatttatgagatggaaagagcaatactttgtaaacgttggcacagattgtggactaacaatagctggattttactacgtatgcttctcctgcagcgatggttccatcagcggtttctattatgatccaaacagcagtccgtttcagaagctggagctgaaaacagttaacgaaggaagatctggtttcagcttttcttcttacgagttgcaatgatgaatgctaccaaaatcatcagacagcgccatatgatactctcgtctaaacatgcgatgcacgtgatccagtacattatgacgtgtcaattattataaattattagtaagatatttttttgcttagctagtagaccagaccaagtaaagaactaaaaatactattttgtcattatggtaccaagctaatagtttatctggaaaaagaacaaattgtccaaaaaaataattaccaaatagttgagaagtttttctaaa

SEQ ID NO: 358 - DNA, 1531 bp, Arabidopsis thaliana
agtggccctaatcactcttgcagtcaccactgtcgccgtccgtctctccttctccttcttagggaccattcctcctctttcagaccagattctagaagaggaaaaatggcaggatgtgcaatgaatcttcagttctcaagtgttgtgaaagtgagaaacgagatctcttcttttgggatttgtaatcgagactttgtatttagagatttagccaaggcaatgaaagtgcctgttttgcggattagaggtggttcaggtaggcaaaggtcgaggcttttcgtggttaatatgtctcaatctcccattgagccacaatctggtggttttgcggctactgaacaaattaaaggagaaggtgataatagtatcttagggaaagacaatgttagaaacttaggaactgatcagcttgagaatttggatattgatggtaatgttggagatggttttaatggtagtgatggtaatgggggtggtggaggaggtggaaatggaggagaaggtgatggtgaaggtgaagactacgaagaaaaagagtttggaccgatattgaaatttgaagaggtcatgaaggagactgaagctagaggagctactcttccatctgatatgttggaagctgctaagaactatgggatccgcaaagtgcttctccttaggtacttggatttgcagagctcagcagggcttcttgggtttgctataagatcatgggctatgcttcgtaacagaatgttggctgatccatctttcctcttcaaaataggggctgagatagtcattgattcttgctgtgccactgttgctgaagttcaaaagagagggaaagatttctgggcggagtttgagttgtatgttgctgatcttttagttggaactgtggttaacattgctctggtcggtatgttggcgccttatgttcgttttggacaaccttccgcatcacctggcttcttaggacgcatggtttttgcatataatgcgcttcctagcagtgtttttgaagctgaaaggccaggatgtagattttccgctcaacagagacttgctacatacttctacaagggtataatgtatggtgcagttggatttggatgtggcattgtaggtcaaggcattgcaaatcttatcatgactgccaaacgaaacataaataaatcagaagagaacatcccggtaccaccgctaatcaagagtgcagctctctggggtgtattcttgagtgtttcttcgaatactcgttatcaaatcatcaatggtctagaaagagtggtcgaagcatcaccttttgccaagaaattccctccggcggctatggccttcacagttggtgtacggttggccaataacatctacggcggaatgcagtttgtggattgggcaagattgagcggttgtcagtgaaaacaaccaaaaactcttttttgtgtgtcttatttgatgaaaccatatgttgttgtagcctactcatttctatctgttttactacatttccgttgttatatctaataataagaattttcagctcgaa

SEQ ID NO: 359 - DNA, 1398 bp, Arabidopsis thaliana
aaaaatctggaacggataaaataatttgctcggcttcctcagctccaatggcggcgacgatgatcggaattaacctctcctgcttcaaatcaacatcgttcttctcaccggacctcaattctctccaatcaaagctctctctcctatctctcaaaccctctccaacacagccacggaaatcaacagtcatccgtatgggcggtggtccgagaactttccccggcggtgtatcaaaatggcaatggaaaaggatgcaagcgaagaaacagaaacagcttctcaaagcaaggttatgcagagaacgtcagatctacgagatgcgaaaacgcgccgagctaaaagcggcggtggctgagctagaacgaccatgggaaccgattcataaaccaccgaatctattctcagtttgtgctgatgagcaagttaaagtactcgcggatcggtttcagaaacctggtggatttgatttatggactgatagagatggtcctcaattgtttgagagtgttgatgatttgccttctgctaggttttttcctaaaggtgttgttcatagtgttaaaccttatggtagattatcatctagctctgttgttgatgatggtgatgagagtgaggttaaagatgaagaaattgggaagaagttacgtggtcgtagggtgaggaagagaggtgatgatggaggtaagaggaggactgaaaatcgtggtaatggtgggagattgagaaatggagggtcttcttcttctcaggtgtatgatatgactttgcagaatgatgggagatatgaaattggatcttaggtatgagttcttctttgttgtgtttggatcattgatgtctctgaacataatgtgtatgtaatctggaatagtttgattgtgattatgcaaagttttcagttttagggaagcaagtctctgtgttcaagtataggttttggttgatggattattgattggtataagcattgtctataaactggttaacccaccaaagtccttaaaggcgtcatggatttattagagtaagaaacacgtaaaccatcattggtgacatcaaactgcatgttatcttccgatgtcaatacatttccggatgatgaagcagaataaggcgatgatgatatacataaatccgaattcctctgttctgaatcatctctcctctgttttttcttagtcctacttccttcactttcctcttcttcttcgctcaatgagtttatgatttgtttgactttgatcatgagggtttgacgtttcagccgaacgcattcacggttattggaacggtgatcatcaacaatctcctccacagttaatcccttatttcttgattctgtaacaagtttcgtaaatccccgaataggaacgctcccgctgctacttcctcttt

SEQ ID NO: 360 - DNA, 2849 bp, Arabidopsis thaliana
gccactaaaacgaaatcgtggtcttactctctcttctgagttctgacctgagcacacacacagagattttgattgtgtcactcatggaacccaatatttaccaacttgccctcgcggctctattcggagcttccttcgttgctgtttctgggtttttcatgcatttcaaggcactgaatctagtccttgagcgtggtaaggagcgtaaagagaaccctgatggagacgagcctcaaaatccgaccttggtgaggcggcggagccaagttagaaggaaggttaatgaccaatatggtcgcagtcctgcttctcttccagatgccactccttttaccgatggtggcggcggcggcggcggtgatacaggacggagcaacggtcacgtttatgtcgatgaaattcctcctggtctccctaggcttcatacgccatctgaagggagagcttctgtacatggagctagtagtatcaggaaaactggaagctttgttagaccaatatctccgaaatcccctgttgctagtgctagtgcttttgagagtgtggaagaatcagatgatgatgataatttgactaatagtgagggtttagatgcttcctacttgcaagctaatggtgacaatgagatgcctgcagatgctaatgaagaacaaatatctatggctgcttcaagtatgattcgatcccatagtgtgtctggtgacttacatggagttcagcctgatcctattgctgctgacattcttcgtaaggagccagagcaagagacctttgtccgtcttaatgttcctcttgaggtgccaacgtccgatgaagttgaagcctataaatgtctgcaagaatgtcttgaactgcggaagaggtatgtcttccaagaaacagttgcaccatgggaaaaagaagtcatatctgatcctagtactccaaagcctaatacagagccatttgcacactatcctcagggaaaatctgatcattgttttgagatgcaagatggggttgtccacgtgtttgcaaataaagatgcaaaagaagatctcttcccggtagctgatgccacagcgtttttcactgacttgcatcacgtactcaaagtcatagctgcaggaaacatccggactttgtgccaccgtcgactagtgctcctagaacagaaatttaatctccatttgatgcttaatgcggataaagaatttcttgctcaaaaaagtgcaccacatcgtgatttttataacgttaggaaagtcgacactcatgtgcatcattcagcttgcatgaaccagaaacaccttttaaggtttattaagtcaaagctccggaaagaacccgatgaggttgtaatattccgagatggaacatatttgaccttgagagaagtttttgagagcctggatctgactggatatgacctgaacgtcgaccttttggatgttcatgcagacaaaagtacctttcatcgttttgataagttcaacctaaagtataacccttgtggtcaaagtaggcttagggagattttccttaaacaggataatctcatccaaggtcgatttcttggtgagataacaaagcaagtcttctctgaccttgaagctagtaaatatcagatggctgaatacagaatatctatatatggcagaaaaatgagcgagtgggaccaactcgctagttggattgtgaacaatgatctatacagtgagaatgttgtctggttaattcagctcccacgcttgtacaacatttacaaggacatgggtattgtgacatcgttccagaatatcctggacaatatattcattcctctgtttgaagccacggtagatcctgattcccatcctcagctccatgtttttttgaagcaggttgttggatttgatttggttgatgatgaaagcaaacctgaaagacgtcccacaaaacacatgcccactccagctcaatggactaacgcattcaatcctgcattttcgtattatgtctactattgttatgctaacctctatgtgttaaataagcttcgagagtcaaagggcatgactactatcacgctacgaccacattctggagaggctggtgacattgaccacttggctgctacgtttctaacatgccatagcatcgcacatggaatcaatctgcgaaagtctcctgtgcttcagtatctgtactacctcgcccagattggtctggccatgtcaccactgagcaacaactctttgtttctagattaccaccggaacccgtttcctgtgtttttcttaagaggtctcaatgtttctctgtctactgatgacccccttcagattcacttaactaaagaacctctcgtggaagagtatagcatagctgcatcagtttggaagctgagtgcgtgtgacctgtgcgagatagctcgtaactcagtgtaccagtcaggtttctcacacgccctgaagtcgcactggattggaaaagattactacaaaagaggacctgatggaaacgacattcacaaaacaaacgtgccacacataagggtggagttccgtgacacgatctggaaagaggagatgcaacaggtttatctgggcaaggctgttatctctgatgaagttgttccataaaaaccacaatcagaaatggcaagacgtaagaatccaacatattgcaggggaacaaagagagcattttgagaagtatacgaaagcaggaacctagtagatagggtaataatatgagtggctctgtgccctgagaaagcgattaggctgtgccaaaatcttattgttttataaagctttttagataatgagatacaaagagaccagttgagaaccggttttaatataatggatttcagtttttggatt

SEQ ID NO: 361 - DNA, 1000 bp, Arabidopsis thaliana
atccacatgttgatgaatggagaagtccgagaaatgacgaaaatcagaaatttcttatccacatagaacactaaggcaatgttcattgatcatcaaaagtcttgtgaattgtagccactatggcagtctcctcactctcaatccgctgtggtggtttctcaccaacaatctcccacaagacagaaattctctgtccaaatccatcactcaaagcttgttgtttactttcatccggtgcttaccaaaaaggcagcggaaacaattggaagagaaggcaagctcttgtgggagtaggaactttagtggcaacttcaattccagcaactttgcttcttgctgaagagataccaaaaagctactcgccttttgtggatcgagaagacgggtattcttactattacccatcagactggagggaatttgacttcagggcacatgattcagccttcaaagatagatacttgcaactgcagaatgtgcgggtcaggttcataccaacggagaaaaacgacatccatgaagtaggtcctatggaagaggtggtttatgatctagtgaagcataagtttgcagcaccaaaccaagtagctaccatctacgatatgaaagagggtggaagatggaaagaactattacacgtttgagtatggactaagaactcctatctatgcaaccacttcctttgcaacagtggcagttggaaacaacagatactacactctcatagttggagcaaatgagagaaggtggaggaaagtgaaaaagcagcttcaagttgtggccgactctttgaagatccttcagatttgacaaacacaagaaacatcttactcctatatatctttctctctctgtggttacaaaactgtctgtagataacaatttgatattttcatattctctataactccaacgatggttttggcattgtgagttagattctgagttggttcagtaattcaatcaaacttgcaaataaagtggaaataatgtatttaca

SEQ ID NO: 362 - DNA, 1526 bp, Arabidopsis thaliana
caatgctacggttttaccactggagatttccgccgtccctcgccgtcgttagaatgctctcatcaccaccccctcctcactcacactctccattctccggcggcggcgtgaattcgaactcagtcggtggaaactccaaacccgagttacaattccctcaatcccaaccccataaactctcttcctctccttcctcttctctgaaatccacggtggcttgttcaaacgccggagctatacggagaagcatggctactgtttctcaggcattctcagagagaacagagtctattgattcggatttaggctcgctcgttgtagtttcattctacaaattcgctgattttcctgagcatgctgatttcaggaagcctctcaaggatctctgcgaaaaattgcgtgtttcaggtggaatcattcttgcaccagaagggataaatggaagtatctgtgggattcgtgaatcagtggaggaagtgttggcatttatacagagagatgtccggttaaatggtttgaggcaagtggagacacctgtgagtcctgagcaagaagcaattcaccatggacatagtagtagctctcctcttgcagctggtgaagatgctccatttagatgggatcatgttagggtcaaacttaagaaagagattgttacgcttggaattcctagtgtctcgccaattgaaagagttggaacatatgtgagtcccgaagaatggaacgaactgatcagtgatccagaaactgtagtgattgatgtgcgtaatacctatgagactagaattgggaagtttaaaggagctgtggatccatgtaccacagctttcagaaatttcccatcttgggtggagaatcaatttgcattgaagcaagaaggcaatgaaacgcaagcaaaggtggagaaagaggatttttctgaaatcacccataaagaagacaaagctgaaaaaccgaagacgctgccacgaattgctatgtattgcactggaggaatcaggtgtgagaaagcttcaagcctccttcttagccaaggtttcgaagaggtatatcatctgaaaggtgggatattaaagtaccttgaagaagtccctaaaaccgagagcttatgggaaggggaatgctttgtgttcgacaaacgtgtatctgtggaacatggtctagctcaaggaacacataaactctgctatggatgcaagcaacctataagtgatgaagacatggaagctccagagtacgagtatggagtttcttgcccttactgttactccaagaaatcagaagaggagaaagaaagggcaagagcaaggcagacacagtttgaggaatggggtgtaattggtggtccggacaaaggtcgtcgacccgccactaaacctgatagtccaaggaagaagatcaatgcaaagcttggttcttcaatatagaatgatgttgttttgttcttcttcttgaaatcatttgcattgttacatacttacattaaagagtttaaacgctaatcaatgaggcaatgatcttgaatt

SEQ ID NO: 363 - DNA, 2575 bp, Arabidopsis thaliana
ggctgtgaatggctaccgttaccaatttcaagctcgtcactccgccggaatcttcccgcgccgataagccaggagctacgaaggcctccgacgcattccaggagaagaaatctgtgtctgtgaactacgaccgtggtgagcatgaggtctcggtcaacatcggcgggctcaggaaagctgatattccgagacgttaccgaattcgggttgagaacgaccggtttcagaaggattggagtgtatcggaggttgtggaccggcttatggctctcaatcgttgggaagaagttgatggcgttcttaattcctgggtcggccggtttgctaggaagaatttcccggttcttatcagggagcttagtagaagagggtgtattgagctttgtgtgaatgttttcaagtggatgaagattcagaagaactactgtgcaaggaatgatatatacaatatgatgattaggcttcatgctaggcataattgggttgatcaggctcgtggtctcttctttgaaatgcagaaatggagctgcaaaccggatgctgagacgtacgatgctcttatcaatgcccatggtcgagctggtcaatggcgctgggctatgaatcttatggatgacatgttacgtgctgctattgctcctagtcgttcaacctacaataacctgatcaatgcttgtggttctagtggaaactggagagaggctctggaagtatgcaagaaaatgacagataacggagttggaccggatttggtcactcataacattgtgttgtcagcatacaagagtggtcgtcagtattcaaaggcgctatcttattttgagctcatgaagggagctaaagttcgtcccgatactacaactttcaatatcattatatattgtctgtcaaagctcggtcaaagtagccaagcccttgatcttttcaattccatgagggagaagagagctgagtgcagacctgatgttgtgacatttacgagcatcatgcatttatactctgtcaagggagagatagaaaactgcagagccgtgttcgaagcaatggttgcagaaggtctaaagcctaatattgtttcctataatgccttaatgggtgcctatgctgttcatggaatgagtggaactgctctctcagtgttaggagatatcaagcagaatggtattatcccagatgtggtctcttatacatgcttgctcaattcttatggaagatcacgtcaacctgggaaggcaaaggaggtattcctcatgatgaggaaggaaaggagaaagccaaatgttgttacttacaatgcattgattgatgcttatgggtctaatgggtttctagctgaagctgtggaaatctttcggcagatggaacaagatggcattaagccaaatgttgtttcagtatgcactcttttggctgcttgtagtaggtctaaaaaaaaggtgaatgttgatactgtactttccgcagcacagtcgagaggcattaatctcaatacggcagcctataactcagccattggaagctatataaatgctgcagaacttgagaaggccattgcattgtatcagagtatgagaaaaaagaaagtcaaagctgattctgttactttcactatccttataagcggttcatgtaggatgtcaaaataccctgaagcaattagttacttgaaggagatggaagatctcagtattccattgacaaaggaggtgtactcttcggttctatgtgcttacagcaaacagggtcaagttacagaagcagaatccatattcaaccagatgaaaatggctgggtgcgaacctgatgtgattgcatacacttcaatgctccatgcttacaatgcttcagaaaagtggggaaaggcttgtgaactcttcctggaaatggaggcaaatggaatagagccagattcgattgcttgttcagctttgatgagagctttcaacaagggaggtcaaccgtcaaatgtctttgtcctgatggatttaatgcgggaaaaagaaatccccttcactggtgcggtcttctttgagatattttcggcttgtaacaccttgcaggaatggaaaagagcaatagacctcatccaaatgatggatccgtacctgccatcgctttctatcgggttaactaatcagatgctgcatcttttcgggaagagtggtaaagttgaagcaatgatgaagctgttctataagattattgcctctggtgttggaatcaacctcaagacttatgcaatactgttggaacatcttttagctgttggaaactggagaaaatacattgaggttttagaatggatgagtggtgctggtattcaaccctcgaaccaaatgtatcgtgacataatctcctttggtgaaagaagtgcagggatcgagttcgagcctctaatacgccaaaaattggaatcactgagaaacaaaggagaaggtctgattccaacttttagacacgaaggcacattgttgtaatttccactatatgcttgtatttttggcccagtgattatgcatatgatgtttgtaacttgtaatctcctctatcgataatatgataattcaattcagaa

SEQ ID NO: 364 - DNA, 918 bp, Arabidopsis thaliana
atggctcctggtggcagtgcattgaaagaagctctagaatctaactcgacaggcgtagattatgaggttaagatggcaaaggttgaggctaatagcaaaccaacaaaatcaggtagtggctccattggaaaattccattcgagcaatggtgtttatgagctccttgaatgtccggtttgtacaaatttaatgtatcctccaattcatcagtgcccgaacggccacacattgtgttcaagctgcaaactgagagtgcagaacacatgccctacatgccgctatgagcttggtaacataagatgcttggctcttgagaaggttgcggaatcattggaagttccatgccggtaccaaaatttagggtgtcaggacattttcccatactacagcaagctcaagcacgagcagcattgcaggtttcgatcctacagctgtccttatgctggttctgagtgttcagtgacgggtgatattccaacgcttgttgaccatctcaaagatgatcataaagttgacatgcatgatgggtgcactttcaaccatcgttatgtgaagtcaaatccgcatgaggtcgagaatgctacatggatgcttacggtcttcaactgtttcggaagacagttctgcttacactttgaggcgtttcagctcgggatggcaccagtgtacatggcgtttctaaggtttatgggagacgagaacgaggctaagaagttcagttacagcttggaagttggagctcacagtcgtaaactaacatggcaagggatcccaagaagcatcagagacagtcacaggaaagtccgagatagtcaagacggactcataatccctagaaacttggctttgtacttctctggcagtgacaaagaagagctcaagttgcgagtcactggacggatttggaaagaagaataa

SEQ ID NO: 365 - DNA, 1747 bp, Arabidopsis thaliana
actttctgtctgtacccaaaagaagtaatgaacctctctcatcttcttcttctctgtttctttcatgttttgtgagttgtttctcaacaattttctggtctcttagagtgagaggagagagatagagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagccgatggagatgttgagatttagttcaccggcgggacagcaaagtcaacaaccgtcgtctgtgccgacgaagaccaccgacggttctcgtttggaccactaggttggtgagccacttttttacttccttatttttggtatgtttcttttttatatctatctttctgaacatacttaaaacgttcaaggatgtattattatagagtaaacgtgcaacttcattacgttattttctgtatatgtgagtttatgtatgtcaaaatgacatgatgagattttttgtaaacaacatcttaaaaacaggacatgtgatttttgtaatcgtaaaaa

SEQ ID NO: 366 - DNA, 823 bp, Arabidopsis thaliana
gctcgtgcagctgaagatccctgctctgattcgtcaaatccatggaagatgaggatgatccaaccacaaagaacagcaacaacacagatgattttgctatagagcctcgtgaagggattatatttgaatccgaggatgcagctaagatgttctatgatgattactctagacgattagggtttgtaatgcgtgtaatgtcttgccgaagatccgagaaagacggaagaattcttgcccggagattcggttgtaacaaagaaggtcattgtgttagtattcgtggtaagtttggatcagttaggaaacctagaccgagtacaagagaaggttgcaaagctatgattcatgttaagtatgaccggtctggcaaatgggtcattaccaaattcgtcaaagaacataaccatccactcgttgtttcacctcgcgaggctcgccataccctggacgagaaggataagagaattcaagaactgacgatagagctgcgaaacaagaagcggttatgtgcagcgtacaaggaacagttagatgcttttgcaaagattgttgaagagcatagtaatcagatagcaaagaaagttgagaatgtagtgaacaatttgaaggagttcgaacatctagagcatgcgctattgcgaagtaaacaagatgccatctaagccaactattgatgtgtgcggctgtatattctttgaattggtgaagctttcccgatcgtaaatggtttaagtgtaatctagatgtggtttgaatcttattttatggaatgtaatgtgaggaactttgtaaccatagagtagaagaggacatggatttaact

SEQ ID NO: 367 - DNA, 1050 bp, Arabidopsis thaliana
tatcgattcctaagttggcgaatacataatgttgctgcgtctctgtcgtcatcgacttcctcttcctctgactttgagcagctctgtcttcttctcgaaatcgtctcctgtttcttctgctttcatggatgcttcaaatcccaattcttctagaaaatctaatgtctcttccttcgctcagtccagtcgaagaggaggaggatatgagagagataacgatcgacggagacctcagggtcgtggcgacggtggaggcggaaaggatagaatcgatgcacttggacgactcttgacgagaatattgcgacatatggctactgagctgagattgaacatgagaggtgatggttttgttaaagttgaagatttacttaacctgaatttgaaaacttctgcaaatattcagttaaagtcacacacgattgatgaaattagagaggctgtgagaagggacaataagcaacggtttagtctcatcgatgagaatggagagctcttgattcgcgctaaccaaggccattcgatcacgacggttgagtcagagaagttacttaaaccaatactgtcaccagaagaagctccagtgtgtgtacatggaacttataggaagaatttggaatccatcttagcatcgggcttaaagcgtatgaatagaatgcatgttcacttctcttgtggattaccaacagatggtgaagtgattagtggcatgagaagaaatgtaaatgttatcatcttcctcgacatcaagaaagctcttgaagatgggattgcgttctacatatcagacaacaaagtgattttgactgaaggcattgatggtgtattgcctgtcgattacttccagaagatcgagtcttggcctgatcggcaatccatacctttctgattcatataattcaacatcatgcgaagattgacaggatcctatgacaatgattgtgaggattcttctgaaccttgattatgtaatgttgtctcagtgttttcaattgcacatatgacaatttatgaaaactttcaagattatgttgtttcctttgcccaaag

SEQ ID NO: 368 - DNA, 1565 bp, Arabidopsis thaliana
ctgcctttaaatctcttcacactcgcctcttcgtctttcctctgtttttcttttactctttctctctctattgaacagtagcgagcagagcaagagattttagtatctgtttggttttgttgttaaagctttttcttcttgggagatgcagagccctaaaatggagcaggaggaggttgaggaggagaggatgaggaataagtggccgtggatgaaggcggcgcagttaatggagtttcggatgcaagctttggtgtatagatacatagaggctggtctccgtgtgcctcatcatctcgtggtgcctatttggaacagtcttgctctctcttcttcctccaattacaactatcactcttcttctctgttgagtaacaagggagtaacccatatcgacacgttggaaactgaaccaactaggtgcaggagaacagatgggaagaaatggcgctgtagcaacacggtccttctattcgagaagtactgtgaacggcacatgcatagaggtcgtaaacgttcaagaaagcttgtggaatcttcttctgaggttgcttcatcatcaaccaaatacgacaacacttatggtttggataggtataacgagagtcagagtcatcttcatgggacaatctcgggttctagtaatgcgcaggtagttaccattgcttcactgcctagtgccagatcctgtgaaaatgtcattcgtccgtctttagtgatctctgaattcacaaacaaaagtgtgagtcacggcagaaagaacatggagatgagttatgatgactttattaatgaaaaagaggcgagtatgtgtgttggagttgttcctcttcaaggtgatgagagcaaaccttcggttcaaaagttcttccctgaggtatctgataaatgcttagaagctgcaaaattctcaagcaacaggaagaatgatataattgcaagaagcagagaatggaagaatatgaatgttaatggtggtttgtttcatggtatccacttttctccagacactgttcttcaagaacgtggttgttttcgtttacaaggagttgaaacagacaatgaaccaggaaggtgccgaagaacagatgggaagaagtggagatgcagcaaagatgttttgtctggtcagaagtactgcgataagcacatgcatagaggtatgaagaagaagcatccagttgatactactaactcacatgagaatgccgggtttagcccgttaaccgtggaaacagctgttagatcggttgtgccttgcaaagatggagatgaccagaagcattctgtttcagtcatgggaattacactgccccgagtttctgatgagaagagcactagcagttgcagtaccgacactaccattactgacacagctttaaggggtgaagacgacgatgaggagtacttgtctttgttttcaccaggtgtttagaaacatagaaatgttgtcgaggttcaaatgatgtttttagtttcaatctaaggatctttctgtgttagatgttagaagaagtcaaatcacaaaaaaatatcgagacacgaattttagctaagattatatt

SEQ ID NO: 369 - DNA, 3799 bp, Arabidopsis thaliana
gaagaacgaattgtgcaaaagtctatagagaaagagagattcatttgtgtttcttcgactatacacagaatacaaaagagatattatatgtaattatcaatagtatatgacaaatttatagcctcacctttcttcttcttcttcttcttcttctgtgtgtttttgaatttgctttcttcaagaggtttcttctccacaccgcttcggtgtatgatctgattgtgatctctctcgatatctgggatcttcggggtatggaggctgtagattattattattattacgtgtggtgctgatgcaatgagtgttgatgcctgttatggaaagagtagctgaagaaactgtggcgactaacaacatacaattgaaagcacgagtggatgatgttccttgtaataagcttgatgctcgtcataacgatatggtgattcaatcagaaactgcaaacagtgattgtcctggaagctcagctcacaggaatgttgatttgactaagccgccgcctcctgaggaagccgcaggagctaagctttctgttgaagagttgacattggggaactacaggattgttcaagggagtaataatactaatgtggatagtcctagggctggcaagtttgagcatctttatcgtttggctagagggtctgcttttagggcaggagatggggatcttgattctcaacctcgtgatatggatcaaatgttgtccagaatcagacaacagcttgctggagctccttctgagaggcaaaacttgaaaccttttatgtctaggaggagcgatcagaatcttgaagctttttctgaacgtctaagagcagctggtgagaatagtattatgaatgctcctgcattgatcagtgaaggtgtccaaatgaaaacgccggtgagttcttcgaatttttctcagttgttacttaaaagagctatgaaagggaaaggggtagtaggaaagaaccaggaaactcctcctgaatttgtctctgatcaagatttaggaagcaaggaaaaaaagttggatattagcaagtcgcctactcctcacgatgtgttacctctaaaatcaagtcccaaaggaaatggtatggtatcacatggtgatgggaatcatagtaaatcttctattggaatcagtttgagggagtttcttagatcaagttatgctaaaagagaaaaaagacatggcctttgtctatttaggcagctggtggaactggttgactcagcccattcaaaaagattattcttgctagacttgagaccatcccttttcactttagttccatcaaagaaacttagatatattggtaattttggaaagaacgatctagaatcagatgttgacgaagatttgaataggaggaggcctgttgttgaggaatcatctagtggaggtagggattcgaagaaaagaaaaatggacttgcatttgaattctccagggaatcaacttcaggccacttcaaccgggcgacctttcaaaaggaaaagccctgtgattgatttaaacatggttgatgcacgtaatccagacagttgcgagcttcaacagcaagactacataaaaaatttaagcgtgtcttcagtgtcgagaaaacagtctatgtccacatggctagaagagcaatggtatacttgtccagaggagataaatggagaagatattggagaaaaatcaaatatttatgcccttggtgttcttctgtttgagttgctatgccattgcgagtcaggcgagatgcatgctgcaatgatggcagatttacgccatcggattctcccaccaacatttctctcgaaatacccgaaggaagctggattttgtctttggcttctacatcctgaaccctcctcccgaccatcagctagagatatactaaagtcagagttgatatgcgaggatgattcagttaaatcgactgctgctgctgaggagatatctgagctgttacttcattttttgtcttcattagaagtgcagaagaagaaaaaagcatctaaacttttgcaagatatccagaccttagaggatgatattaaggaggccgagcgaagatattcttcaaatgtatctctggtgagatctcatggagctattgaaaaaagggtgcaatcatctcccctagacgagcactgtacaacttccagtgccttgtttgtaccaactgctaatacagacaggctgatgagtaatatccgtcaacttgaagatgcatattttttcatgcgatcacaaatcaacttatcgagttctgctgctactgcccgttctgacaaaacactaaaggacagggacagatgctctgaaaaccaaaatgaaaatcaggatatgagtaccaaaggaaaatcttcagatcaactcgaagtgtttttcgaggggttgtgcaaatttgctcggtatagcaagttcgaaacctgtgggacaataagaagtggggaccttttaaactctgcaagtgtggtctgctcgttgagttttgaccctgatgaagaacacatagcagcagctgggatatcaaagaagatcaagatttttgacttcaatgcatttatgaatgaatctgtcggtgttcattatccactagtagagatggtcaacaaatctaaattaagctgtgtttgctggaatagctacatcaaaaactacttggcctcgactgactacgatggtgtagttcagatatgggatgccggcactggacaaggattttcgcagtacacagaacaccagaagagagcctggtcagttgatttttctccatctgacccgacaaaatttgttagtggaagtgatgactgctcggtgaagctttggagcatcaatgagaaacgttcattaggcacaatctggagtccagcaaatgtgtgttgcgtgcaattctcttcttattccaatcacttattggcatttgggtcagctgattacaaggtctattgctatgaccttcggtatgtcaaaacaccttggtgcacattggctggtcatgagaaagcggtgagttatgttaaatttatggattcagaaaccattgtttctgcttccactgataactctctcaagctttggaatcttaacaagacaaattcctctggtttatctcctggtgcttgttcattgacatataaaggacatacaaatcagaagaatttcgttggattgtcggttttggacggatacatagcttgtggttcagagaccaatgaggtatatagttactataaatctttaccgatgccaatgacttcatacaagtttggatccgtcgatcccatttctggaaacgaatactttgatgacaatggacagtttgtgtcgagcgtctgttggaggaaaaaatcgaatatgcttgtagctgcaaactctactggaaacatgaagctactaaaacttgtttgacaacttggccttttcgctactactgcgggcattggactttttgagtctgaaactaggacaaagcaggtctgactttgaagcaaacgtttttgtcctggaaactatgatcccatatgaccagaagagaaaaaaagttcgaaatcttggagaagttgaagaagcaaaactgtctgtgataatatattatttgattcttcttcctgtaattctatatatatgagatataatttgagataaacttctcagattcttcagaaatgattcatatttggtcggcataacgtgtaatgatgagaggtatataacttgtacaagtgtgttatatcgttagctcggttatgtaattgttgttggagattctctataagagagaaaatatatatatcatccattcatttc

SEQ ID NO: 370 - DNA, 919 bp, Arabidopsis thaliana
tccaatgaaaactccaagatcgtctctacgtccgccacgtcagcactatcctgatcgggaaacccaaaacgagtggtcgaatagtttccgactgattcttccgaggcttgaagctcaatagctatggcttctctttcagtctcttcctcttcaaccatcatcgattcaagagctcctccttctcgactagcctccgcctccgcctcttctccgtcgtgcatttcacttcccacacttccgattcagtctcatacccgtgccgctaaagccactgcttactgtcggaagattgtgaggaacgttgtgacgagagctactactgaagttggtgaagctcctgccactactaccgaagctgagactactgagttacctgaaatcgtcaagactgctcaagaagcttgggagaaagtggatgacaagtacgctattggttctcttgcctttgctggtgtagtggctctttggggttctgctggaatgatttcggcaatcgataggcttccattggttcctggtgttcttgaacttgtaggcatcggttacacaggatggttcacttacaagaacctggtcttcaaaccagacagggaggctttgtttgagaaggtcaagagcacatacaaagacatattagggagcagctgaatcaaaggaggaagaagaagaagaagagcctttttgaggccattcatgaattggaatgaaggatatcaaaagaatctaacacaaaggccacgtccttccttcaatctttccttcttgtaactaaataattttcatcctttctctctctctgtctctggtcttttttagctcaaagtatcatccatttatgtcaaagtgttgtaaattcctcaagactatatatgagatgttttgtttcattttccaaaatttcaaactttgtccccattta

SEQ ID NO: 371 - DNA, 1259 bp, Arabidopsis thaliana
tgagctactagtactaagctacaccacggggtttaatttgtgaaatccgaaactagggagactaaatccgaatagatatagatagcctaagggattcggggctgcaacaaaatcactcccactcactgcgaagctcgactatggcggcgacgtcgctggttctgacgtgcgcatcccctctattcagcagccctcgggttatttctgctacgaagaagctgactacagagttgtcgatttctacagctaaattccgaagaagatgctcgggaaacaatgatgaagtgcttctagaaggaatgccaccggagtattacgatgatagagagaagaccaaagaactgcggcggatgcagcgggaggaagaagaagaagaggagagaaagattgaagaataccgtgaaattggcacgaggttgaaggaatttcccgagcaagacttaaggaaagccagaaagctcgtctccagcttcatcagagctgccgaggaagtcgaagagagaattgaagaagcagccgagaaaggagaacttgacgagcttgtcctcatgatcatatggaaccggcttgaccttgctaggcgcgatgatgagaaggacgccatcagaagtcttgatcttttgtatagaagagtcgagacagagatcttaaaacggcaagcaagtcctgcaatgaaactgctgaatgatcttctaaatatgcatgatggctttgaagacgatgcttggctcaaggactgcagaaaacgaatggctgagaccttcccccgagaagaccccttcagcattctaatgccaccgggattcgacattgatatgcatcaaggacagttgcgaccgcccattgagactgagacagacaacacccttctgagagtagactttgtaagagaagtggatgcactgctacaggaagtgaggatagaggaagacgctacaactggtagcaaaggagaagggcttgatcctgaagctatagcacttaagtttaagcaacaggagaagcaacgaaccatccgccaaattgaagccattcttgatttagccctcaacttgaagtggtaggcagttaactagaatatcaatctatacgccataataatttttttaagatagaccctagagttagattgattcaggcgtttttgtttagaaatgaatggagtctaaataataggttttggctaaaaattccaaatccaaatgttgctgactatctctctgctcatagtctccaccacaatcatctcttcctctttc

SEQ ID NO: 372 - DNA, 1315 bp, Arabidopsis thaliana
aattacaatctctccttttgccaacaatcattgcttaaaaaacacataccttcttctttagttataaaaatgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgtcccttccttctaaactcctatggcgaagatagactagattgcatgctgtaaattacttctagtttggatttctacaagttattactgcatatgggtccttagttttgtgacttttgtcaaactagtacgagtttaatcagatatgttcctatagctgcagttgtttaagcaacatctcgctacataattgaattggtgaaatcttatcatatgga

SEQ ID NO: 373 - DNA, 1738 bp, Arabidopsis thaliana
aattgatctgtggaaaaagcaaagcaaaggtcgaaaacaaattccattcttgaagctgtgaacaattgtagttaccagcttggctattcaagaaaggttccagcatataaaatttatggcatatgcaacaggaataacgtttgcctcaaggagtattttgcctatttgttccagaaccttcttatctcccttgcgtgtcgcttctttactcgtctttcctgagaaatcatctgcaactttcttcagaagggtccaagttcctcaccttttttccacttctactactactctgttctcttctgttaagtgttcaattcattctacttcatctcctgagacagagaatcaagctgtttttcgccctaatgtagtcgatatacttgaagaaagaggtctcctcgagtcaatcacaagcgagaatctcaggtcagcttgttctgatcctaaagtagctcctttaagggtctactgtgggtttgatccaacggctgagagtttacacttgggtaatctacttggtatcattgtgctttcttggttccaaagatgtggacatcaagccgttggtttaattggtggtgccacgggacgggttggtgacccatctggtaaaagcttagaaagacctgagcttgacgctgatacactggagaaaaatattgcggggattacaaaaatcattatcaagattctaggtagtaatccgagtcccggtggctcttacgtgatttttaataactatgactggtggaaagatatgacaatgctcgactttctgaacaaagtcggtaggtttgctagggttggtactatgatggcaaaggagagtgtgaagaagagattagaatcagagcaaggtatgagctacaccgagttcacttatcagttgttgcaagcctatgattttcttcacctgttcaagaacgaagggatcaatgttcagataggtggcagtgatcaatgggggaatataacagctggaactgatttgatcaggaagattctccaagcagaagaagcggcttacgggctaacatttcctctcctactgaaaaacgatggaacgaaattcgggaaatcagaagatggagcaatctggctatctccttcgatgttatcgccttataagttctatcagtacttcttttcagttccagacgttgatgtgatacgcttcttaaagacattaacatttctgagcttggatgagataaagatcttggaagatcaaatgagcaaacccggctatgttcccaacaccgcacaaatcaaactcgctgaagaagtaaccagattcgtacatggcgaagagggtttgaaagaagccattaaagcaacagaagctttaagaccaggtgctgagacaaagcttgattggaacttgattgagagaatagcagaggatataccttcttgctcactgcctattgatcgagtgtcgggtttatcgattgtggatctatcggtttctgcaggtttgtttgagagcaaatctgctgcgaggagaatgttgaagcaaggtgggttttatatgaacaatgagagagttgatgatgagaataagagagtggacgaagaggatattgttgaagggagaggtcttgttctatcagcaggcaagaagaataaagtggtcgttagaatttcctgattttttttcataacaaatctgtactcattttattacgtattttgttatgaactaacgttgaatcactaatggtttataacttttctc

SEQ ID NO: 374 - DNA, 1036 bp, Arabidopsis thaliana
gcatcagtcatcaccacatgcgacacaccaacaccaatgtctgcttcttctttatttaatctcccattgattcgcctcagatctctcgctctttcgtcttctttttcttctttccgatttgcccatcgtcctctgtcatcgatttcaccgagaaagttaccgaattttcgtgctttctctggtaccgctatgacagatactaaagatgctggtatggatgctgttcagagacgtctcatgtttgaggatgaatgcattcttgttgatgaaactgatcgtgttgtggggcatgacagcaagtataattgtcatctgatggaaaatattgaagccaagaatttgctgcacagggcttttagtgtatttttattcaactcgaagtatgagttgcttctccagcaaaggtcaaacacaaaggttacgttccctctagtgtggactaacacttgttgcagccatcctctttaccgtgaatcagagcttatccaggacaatgcactaggtgtgaggaatgctgcacaaagaaagcttctcgatgagcttggtattgtagctgaagatgtaccagtcgatgagttcactcccttgggacgtatgctgtacaaggctccttctgatggcaaatggggagagcatgaacttgattacttgctcttcatcgtgcgagacgtgaaggttcaaccaaacccagatgaagtagctgagatcaagtatgtgagccgggaagagctgaaggagctggtgaagaaagcagatgcaggtgaggaaggtttgaaactgtcaccatggttcagattggtggtggacaatttcttgatgaagtggtgggatcatgttgagaaaggaactttggttgaagctatagacatgaaaaccatccacaaactctgaacatctttttttaaagtttttaaatcaatcaactttctcttcatcatttttatcttttcgatgataataatttgggatatgtgagacacttacaaaacttccaagcacctcaggcaataataaagttttcgtttttatcttaatt

SEQ ID NO: 375 - DNA, 2070 bp, Arabidopsis thaliana
caaatcccattaataaaaaccttaccaacccatgaagtaaagtaaactcctttcttataaactctcttttgttctttttttttcaacttcatcagtctcttaactcaccatcacaagaacaagaaagatgaagagaggatacggagaaacatgggatccgccaccaaaaccactaccagcttctcgttccggagaaggtccttcaatggcggataagaagaaggctgatgatgacaacaacaacagcaacatggatgatgagcttcttgctgttcttggctacaaggttcgatcttctgagatggctgaagtagcacagaagcttgaacaacttgagatggtcttgtctaatgatgatgttggttctactgtcttaaacgactctgttcattataacccatctgatctctctaactgggtcgagagcatgctttctgagctgaacaacccggcttcttcggatcttgacacgacccgaagttgtgtggatagatccgaatacgatctcagagcaattccgggtctttctgcgtttccaaaggaagaggaagtctttgacgaggaagctagcagcaagaggatccgactcggatcgtggtgcgaatcgtcggacgagtcaactcggtccgtggtgctcgttgactctcaggagaccggagttagacttgtccacgcactagtggcgtgcgctgaggcgattcaccaggagaatctcaacttagctgacgcgctggtgaaacgcgtgggaacactcgcgggttctcaagctggagctatgggaaaagtcgctacgtattttgctcaagccttggctcgtcgtatttaccgtgattacacggcggagacggacgtttgcgcggcggtgaacccatctttcgaagaggttttggagatgcacttttacgagtcttgcccttacctgaagttcgctcatttcacggcgaaccaagcgattctagaagctgttacgacggcgcgtagagttcacgtcattgatttagggcttaatcaagggatgcaatggcctgctttaatgcaagctttagctctccgacccggtggacctccgtcgtttcgtctcaccggaatcggaccaccgcagacggagaattcagattcgcttcaacagttaggttggaaattagctcaattcgctcagaacatgggcgttgaattcgaattcaaaggcttagccgctgagagtttatcggatcttgaacccgaaatgttcgaaacccgacccgaatctgaaaccttagtggttaattcggtatttgagctccaccggttattagcccgatccggttcaatcgaaaagcttctcaatacggttaaagctattaaaccgagtatcgtaacggtggttgagcaagaagcgaaccacaacggaatcgtcttcctcgataggttcaacgaagcgcttcattactactcgagcttgtttgactcgctcgaagacagttatagtttaccgagtcaagaccgagttatgtcagaagtgtacttagggagacagatactcaacgttgttgcggcggaagggtccgatcgggtcgagcggcacgagacggctgcacagtggaggattcggatgaaatccgctgggtttgacccgattcatctcggatctagcgcgtttaaacaagcgagtatgcttttatcgctttacgctaccggagatggatacagagttgaagaaaatgacggatgtttaatgatagggtggcagacgcgaccactcatcacaacctcggcgtggaaactcgcctgagtcgcggcggtagagatgactcgcctgaaaccgggaaaaacaataaatgttttaaaaaattaggaaaagagaccgtaactttagttatgtttttactttttaacccgaagtttttgtgtgtttaacctttttgcctaaatgtttacaactttatctttttggaccttgtgcgtatctttgagagttaagagaacgagtaaaaaatcttgtatcgtagatcgagctaagtagttttcaataaatggaaggataacgattctgtatgttttttacttgatccaatatatatgaatttattt

SEQ ID NO: 376 - DNA, 1054 bp, Arabidopsis thaliana
aacatttatcttctgttttttggtggaatgggaagagaagttgttgaggtgcttatggaccgaaacgccgacgtttcaagcgctagagttcatgttgctcctaagatagctgcagaggagactgatgaggaatttgaagtcaaagaatgcacagaggagaagtctctttctgagaatgcaccaaatgttggatctgctgagagagttggagctcagaaatcacctaaaacccgtaatggaaatgctaaagtttcaaagcaggatgctcctcttctcgcggtgaggaagccattgcaacccgagaacaagaagcatattgatgacgaagataattgctccattgcttcttccgttgcaacttccatgaggatgggtaagtctggattgacttatggaagtgctccaacgtttaggagtgctcaacgtgctgagaaacgcaaggagtattaccaaaagctcgaggagaaaaaccaagcgcttgaagctgagaggaacgagcttgaacagaggcaaaaggatgaacaagaagcagccttgaagcaacttagaaagaatctcaagttcaaggctaaacccgtccccaacttctactacgaggcacctcctgcgaaacctgagctcaagaagcttcctttgacacgtcccaagtcgccaaaactgatcctttctcggagaaaaagcttcagcgacgcagtcagctcgtcttcccgtgaagagattctgaagacagtctctaaccggaaccgacacagcactggaacagttcagaacaaagacgatgatcacaggaacaagaacaccaatgctgcgcacgacagccctcgtgtcagatcaggcaaaggtaaatccggattgaaaccagtgaacgagtcctcagaagaagcttgaaatttcaaaagatgatgctttgttggtctaacttgatcttgccggagaaaatgtaaaatcaaagactctttgtttttcggttatttccggtatacgtttggttcactatgtaactgtcttttttcgattttaagttttaacatgaaaaactttatgttgattgttg

SEQ ID NO: 377 - DNA, 2096 bp, Arabidopsis thaliana
atccaataaaagttgtgaaaaaaagccgcaaagggtcgttgttgtttgtcgcctctcaatggcagcttcttcaactaatgctcgtctcaccaaccctcctcgtctactctccaaaccccgactttcacctacctccgtcgccaatctccgttttccagccgccgatttctccactcgcttctttgccgattcttcgtccccgcggctaaggagtgtaccgtttccggtggtattttccgatcaaaggcgccggcgaagcatggaacctagcaatgtctatgtggcttcaaattccacggaaatggagatcggaagtcatgatatcgtgaagaatccgagcttgatctgtgctccagtgatggcggattcaatagacaagatggtgattgaaacgagtaaagcccatgaattgggtgcagacttggttgaaattcgattagattggctaaaggacttcaatcctcttgaggatctaaaaaccattattaagaaatctcctctacccactttattcacctacagaccaaaatgggaaggtggtcagtatgaaggtgatgaaaatgagagacgggatgtgcttcgtctggccatggagttgggagctgattatattgatgttgaacttcaggtggcaagtgagttcatcaaatctattgacggaaagaagcctggaaagttcaaagtaattgtttcatcgcacaactatcagaataccccttctgttgaggaccttgatggccttgttgcaagaatacaacagactggagccgacattgttaagattgctactactgctgtggacattgcagatgttgctcgcatgttccatataacctcaaaagctcaagttcccacaattggacttgttatgggtgaaagaggtttgatgtctcggattctttgttcgaaatttggtggttatttgacctttggcaccttagattctagtaaagtttctgcgccaggtcaaccaacgatcaaggatctgttggatctttacaactttagaagaattggtcctgacacaaaggtatatggaattattggcaagcctgtcagccacagcaaatcacctattgttcacaatcaagctttcaaatcagttgattttaatggagtatatgtccacctgttagttgataatcttgtaagctttcttcaagcatactcatcctctgatttcgctggattcagctgtacaattccgcacaaagaagctgcattgcaatgttgtgatgaagttgatccattggcaaagtctataggagctgtgaacactatactaaggagaaaaagtgacggaaagttgttgggttacaacacagattgtattggttccatttctgctattgaggatggcctacgaagttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacgaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccgctccaaaggaactctactggcaaataatgtcaaagtactgagacatagcttaagtgtgtgtgtgtgtacttccatgaaaagtcgtcgattcaataaagctttagattgccatttgtatgttccgagaatgtccttttttgaggccataagccgaatgactggttctctctttgtatttatatatatgtataaactattaagcctaacattaatcttttttaagtttctttgatttgatgagtctactataaaaaagaagggttaagt

SEQ ID NO: 378 - DNA, 1769 bp, Arabidopsis thaliana
gagtatcgacgggaattatccgtaaacagagtgacagtgaggtgtgaaggaagaagacgatggcgtcaatgtctctctccttttcttcttcgctatgttcatccagaatccccgaaggtaagcgtaggtttcgtcacagagatgtgggcatcgttagatgcgttttggctgcttcgaaatcttctccgggaagtgttacgaagaagaggctttggaaagacggcgaattccccggaatcacggagccggttaatcagagaagaactccgataaagaatgtgaagaagaaacttgacaggagaagcaaagctaacggatgggttaacaccgtcactgaaactttgtccgatctcatcgccaaaaagcagtggttacaagctctcgaggtttttgatatgttgagggaacaaacattttatcaaccaaaggaaggaacttacatgaagctgcttgttcttctcggtaaatctggtcaacccaatcgtgcacagaagctgttcgacgaaatgcttgaagaaggacttgaaccaactgttgaactctacactgctcttctcgctgcttacactcgcagcaatctcatcgacgatgctttttcaattcttgataaaatgaaaagctttcctcaatgccaacctgatgttttcacgtacagcactctgctcaaggcttgtgtggatgcttctcagtttgacttggtggattcgttatacaaggaaatggacgagcgtttgataactccaaacactgtgacccagaacatagttttaagtgggtacggtagggtcggaaggtttgatcagatggagaaagttttgtctgatatgttggtgagtactgcttgcaaacccgatgtgtggactatgaatatcatccttagtgtgtttggaaacatgggtaagatagacatgatggagagctggtacgaaaagttcaggaactttgggattgagccagagactcggactttcaatattttgattggttcttatgggaagaagagaatgtatgataagatgtcgtctgtcatggaatacatgcgaaagctagagtttccgtggacaacatcaacctacaacaatatcatcgaggcgtttgcggatgttggtgatgcaaagaacatggagttgacatttgatcagatgcgtagcgaaggtatgaaagcagacacaaagaccttttgctgtctcataaacggatatgccaatgccggtcttttccacaaggtgataagtagtgttcagttggctgctaagtttgagatacccgagaatactgccttttacaacgcggtgatatcagcgtgtgctaaagcagatgatctgatagagatggaaagagtgtacataagaatgaaggagagacaatgcgtatgcgattcaagaacgtttgagatcatggtcgaggcgtatgaaaaagaaggtatgaatgataagatctattacttggaacaagagaggcaaaagcttatggatcgcactgttgctacaaaagagatggagaatcttccggcaggatgattgcggtttgtgtgtgaatctctctctctctctctctgcaaggagagatcgatgtctcacttgaaagagtagaataaaagagtttgtaatacacttgattgttcttgcagctatgcgtgttatatattttgatgggcccaaaattatgaatagaggcccatagataaactgtgacgtgcacaagaaatcggacaagtccaaaaagtggataagtgcgtgtcgtctttctataaataatctcttttctct

SEQ ID NO: 379 - DNA, 1196 bp, Arabidopsis thaliana
attcacatcgtgaacgtgacttttctatagctagtggtcaactcgacacgtggcatcatctcaacggtctccttgattctctcgtcatagaaacgatgcactgaatcaatctccataacttcagggcattgcccttctatataaacatcacatgtccctgtgtcttaaaatacctcttatcaaacaccaaaccacaccagaacagaactcagccatggcttcttcttcttcttctcttctaatcctagccgttgcttgtttcgtctcgctaatctcaccggcgatttcacaacaggcttgcaaatcacagaacttgaactccgccggtccgttcgatagttgcgaagaccttccggtactcaattcctacctccattacacctacaattcctcaaattcatctctctccgtcgctttcgtcgccactccatctcaagccaacggtggctgggtcgcttgggctattaaccctacggggactaagatggctggttctcaagccttcctcgcttacagatccggcggtggtgcggctccggtcgtgaagacgtacaacattagcagctacagcagtctcgtcgaaggtaaacttgcttttgatttttggaatctacgcgccgagtcgttaagcggcggtaggatcgccattttcacgacggttaaggttccggcgggagctgatagtgtgaatcaggtatggcagatcggcggcaatgttaccaacggtcgtcccggtgtacatcctttcggtcctgataatttgggctcccaccgtgtgttgagtttcacagaagatgcagcaccgggctctgctccttcgccgggatctgctccggcgccgggcaccagtggctcgactaccccaggaacagcggcgggaggtccagggaacgcggggtcattgacgaggaacgtaaattttggggtcaatttgggaattttggttttgttgggttctatttttattttctgaatggggatctctctctagtctctcttctcttcttgagtctctctctatttttttttttttttggtttgttcgaacaataatggtgccccatacttttgtactgttttagtcttagggccatttactttgtttcaccacattacttagagttattggattgtatggaccattactatcatgagattgagatcatcttatcttcttaaaatatctatttgccatc

SEQ ID NO: 380 - DNA, 1006 bp, Arabidopsis thaliana
atatctgaaagactcaaaaacctatcgtcatttatcttcaacaggcggaataacggagatggccgccattacagctctcactctccgctctcctgtttatctcccatcatctgccacaagccctagattccatggcttcaccaatcaaccaccaccagctcgtctcttctttcctcttaaccccttcccttctctatcaatccaaaaccctaaatccatccgaatttccgcatccgcttcgccgataacaacaccaatcctccagacggagaagtcaacagctcggtcatcgacactcaccgggtccactcggtctctcgctactctcgcggctttagcaatcgctgtaaccagagtcctagctcagaaactctctctcgcaatccagacttcaagtcccgtaatcgccgacgggttacgattctctctcagtaccgccggacctgtcttcttcgcgtctctccgggatcgtcctccgggatacttgaacacgccgctgacggttgttgcggtggggataaagaagtggctagacatttacagtggggtattgatggttagggttttgctgagttggttccctaatatcccttgggaaagacagcctttgtctgccattagagatctctgtgatccttacttgaatctcttcagaaacatcattcctcctatcttcgatacgcttgatgttagtccattgcttgctttcgcggttcttggtacacttggatcgattgttcatggcagcactgggtagaaattggaagacttgagctaatggttttgttgaaacgttcaattgggaaatttctgcaacttgtttcccaagattagggaaaaatcagaatttgatgctgtgttggatgctcgatgagagttgtgagctttatcgtttttgttgttctctttttgactttgattctgaataatgagattttgggttgttgtttatctcctaattacatgttcagactaccgtttattgatggattatctgcgttctctc

SEQ ID NO: 381 - DNA, 823 bp, Arabidopsis thaliana
accgcttaccagttactaacttgagcttcagagatcatcatcatcatcacttcctctctctgaagaaaacacaatttggagttttctaatcttcattccaatggaagggaactctttacccgaagaagatgtagagatgatggagaattcagatgtaatgaagacagtcacagatgaagcttctccaatggtggagccgttcattggtatggagtttgaatcagaagaggctgcaaagtctttctatgacaattacgctacatgcatgggtttcgttatgcgagtggatgctttcaggaggtcaatgcgagatgggactgtggtgtggcgcagactcgtgtgtaataaagaaggatttcgtaggtcgagacctcggagaagcgagagtagaaagcctcgggctataacaagagaagggtgtaaagctctgattgttgtgaaaagagagaaatccggaacatggcttgttactaaatttgagaaagagcataatcatcctctcttgcctctctcccctaatgttcgccggaattttcagctccctcaaacaccggacgagaaagacgcaaagattagggagctgagtgcagagctgagccgagagagaaggcgttgtactgctttgcaacagcagcttgatatggtccttaaggagatggaagaacattccaaccatctcaccattaacatcaatagtgttatccaaagtgttagagacattgagtccaatactttcaccaaacaacaaacataatgcttcatttctgttcataaaagcttaacatcaaattctcataatccaatgttctgtatcttgtgattg

SEQ ID NO: 382 - DNA, 2370 bp, Arabidopsis thaliana
atggtctcattctccgcaccaaagaaacgaaggagaggacgttctcagcgctcaatgtcttcgcttaattcccttcccgtccctaacgtaggtcttcttcctggtaacagtaatttcgtgtcatcttcagcttcttcttccggtagatttaacgtagaggtcgtcaatggatcaaaccagactgtgaaaagttatcctgggattggtgatgagatcattacgattaacaaggaagctaccactgaagctttgcttgctctcactgctgggtttcctgctgattcgcttaccgaggaagagattgaattcggtgtggtgcctattgttggaggcattgaacaagtcaattacattttgattaggaaccacattatatccaaatggcgagaaaatatatctagttgggtcacaaaggagatgtttcttaattcgattcctaaacattgtagtagtctcttagattcggcttataattacttggttacacatggatatatcaattttggaatagcacaggcgattaaagataagtttcctgctcagtcaagcaagtctagtgtgattatagttggtgctggtttatctgggttggctgcagctaggcaactgatgaggtttggcttcaaagtcacggttttggagggtaggaaacgacccggtggacgggtttataccaaaaagatggaagctaatagggtaggtgctgcagcggatttaggtgggagtgttttgactggaacattaggaaatcctttagggattatagcgagacagcttggttcttctctctataaggtacgagacaagtgtcctctttatagggtggatggtaagccggttgatccagatgtggatataaaggttgaggtagcgtttaaccagcttctagacaaggcaagtaaacttaggcagttgatgggtgatgtttccatggatgtctcccttggggcagcactcgagacattcaggcaggtttctgggaatgatgtggccaccgaggagatgggtttgtttaactggcatcttgctaacttggagtatgcaaatgcgggcctagtatcaaagctttctcttgcattctgggatcaagatgacccatatgatatgggtggagatcactgctttctgcctggaggaaatggaaggctggttcaggctttggctgaaaatgtaccaatattatatgagaagaccgtccaaacaatcagatatggttcaaatggtgtcaaggtaactgctggaaatcaagtgtatgagggtgatatggtgctgtgtacagttccccttggtgtccttaagaacggatccatcaaatttgttcccgaattacctcagagaaagcttgattgtataaagagattaggttttgggttactgaataaagttgcaatgctctttccgtatgtattttggagcacagatctcgatacctttgggcatcttactgaggatccgaactatcgaggtgaattctttctgttctatagctacgcaccggttgctggtggtgctctcttgatcgcgttggttgcgggagaagctgctcataagtttgagacaatgccacccactgacgcagtgactcgtgttcttcatattcttaggggtatttatgaacctcaaggaataaatgtccctgatccacttcaaacggtctgcaccagatggggtggggatccattcagtttaggatcttactctaatgttgcagtgggagcttcaggcgatgattacgatatattagcagaaagtgtgggagatggaaggcttttctttgccggagaagccacaacaaggcgataccctgcaaccatgcatggagcttttgttactggtctgcgagaagctgcaaacatggctcaatctgcaaaggcccgaggcataaggaaaagaatcgataggaacccatcaaggaatgctcattcctgtgccattcttcttgcagatttatttagggaccctgatctggaatttgggagtttttgcataatctttagtaggaggaatccagacccaaaatctcctgctattttgagggtaactctaagcgagcctcgtaagagaaacgaggacccaaaagcagatcagcactcaaacaagatactgtttcagcagcttcagtctcatttcaaccagcagcaacagattcaggtgtatacattattaactagacaacaggctcttgacctgagagaagtcagaggtggtgatgaaaagagactatactatctctgtgagacacttggagtgaaactggtggggagaaaaggtcttggtgttggagctgattcagtcattgcttctattaaagccgagcgaactggtcgcaagctaccatcatcatctacctcaggcacaaaatctggttag

SEQ ID NO: 383 - DNA, 1376 bp, Arabidopsis thaliana
aaaagaatccctggacctaactaaccacatcacttcaccggataaaacctccaccgtcttcttccgccgcaatttctgtctccatggccggcgttaacctacagctccgtcacgcatactccatagctcaattcgttccaactgtttcttctcctcctcctcttcctactcagcgagttcgcctcgggacttcaccctctcgtgttctattatgcaatctccgagctaattccgccgccgctccaatcctgcgaactactcgccgttcagttattgtttcggcgtcttccgtatcctcagccgtcgattcggattcgttggtggaagatcgtgatgacgtggggaggatcccgttgcttgaagttagggatttgagagcagtgattgctgaatcgagacaagagatactgaaaggcgtcaatttggttgtctacgaaggagaggttcacgcagtgatggggaagaacggttcaggaaagagcacgttttcgaaggttcttgttggtcatcccgattatgaagtgacgggagggagtattgtgtttaaagggcagaatctacttgatatggaaccagaggatagatctcttgccggtctctttatgagtttccagtccccagttgagatccctggtgttagcaatatggatttcttgaatatggcattcaatgctcggaaaagaaagcttggtcagccagagcttgatccaatccagttctacagccacttggtatcaaaactcgaagttgtgaatatgaagaccgattttctcaacagaaatgtcaatgaaggatttagtggtggtgaaaggaaacgcaatgagattctacagttagcggtccttggagctgagttggctatactggacgagattgattcagggttggatgttgatgctcttcaagatgtggcaaaggcggtgaacgggcttttgacaccaaaaaactctgttctgatgataacgcactaccaacgcctacttgactacatcaaaccaactctcatacatatcatggagaatgggagaatcattaaaaccggagacaactccttggccaaactactggaaaaggaaggctacaaagcgatatccggttagttatcgcggatcatacatataacctgtcttccttctttgagagaccatggttattatatgggacaaatacaatggaagctaaagctgatgattggaaactgaaatctatcactacaatctttgacccgtagttttggtttgcaatttgcatgacaaactactttattgggatgtgaacagtattccacacctttttgtaactaacaagtttaaaattcagttaataaattttgttattataaatgctcttataaagtttgagactttaagtggatc

SEQ ID NO: 384 - DNA, 2044 bp, Arabidopsis thaliana
attagcagcactctcacgaaatcgtcgtgacgaaacgataaaccctaagtcatggtaaaggaaactctaattcctccgtcatctacgtcaatgacgaccggaacatcttcttcttcgtctctttcaatgacgttatcctcaacaaacgcgttatcgtttttgtcgaaaggatggagagaggtatgggattcagcagatgcggatttgcagctgatgcgagacagagctaactctgttaagaatctagcatcaacgttcgatagagagatcgagaatttcctcaataactcggcgaggtctgcgtttcccgttggttcaccatcggcgtcgtctttctcaaatgaaattggtatcatgaagaagcttcagccgaagatttcggagtttcgtagggtttattcggcgccggagattagtcgcaaggttatggagagatggggacctgcgagagcgaagcttggaatggatctatcggcgattaagaaggcgattgtgtctgagatggaattggatgagcgtcagggagttttggagatgagtagattgaggagacggcgtaatagtgatagggttaggtttacggagtttttcgcggaggctgagagagatggagaagcttatttcggtgattgggaaccgattaggtctttgaagagtagatttaaagagtttgagaaacgaagctcgttagaaatattgagtggattcaagaacagtgaatttgttgagaagctcaaaaccagctttaaatcaatttacaaagaaactgatgaggctaaggatgtccctccgttggatgtacctgaactgttggcatgtttggttagacaatctgaaccttttcttgatcagattggtgttagaaaggatacatgtgaccgaatagtagaaagcctttgcaaatgcaagagccaacaactttggcgtctgccatctgcacaagcatccgatttaattgaaaatgataaccatggagttgatttggatatgaggatagccagtgttcttcaaagcacaggacaccattatgatggtgggttttggactgattttgtgaagcctgagacaccggaaaacaaaaggcatgtggcaattgttacaacagctagtcttccttggatgaccggaacagctgtaaatccgctattcagagcggcgtatttggcaaaagctgcaaaacagagtgttactctcgtggttccttggctctgcgaatctgatcaagaactagtgtatccaaacaatctcaccttcagctcacctgaagaacaagagagttatatacgtaaatggttggaggaaaggattggtttcaaggctgattttaaaatctccttttacccaggaaagttttcaaaagaaaggcgcagcatatttcctgctggtgacacttctcaatttatatcgtcaaaagatgctgacattgctatacttgaagaacctgaacatctcaactggtattatcacggcaagcgttggactgataaattcaaccatgttgttggaattgtccacacaaactacttagagtacatcaagagggagaagaatggagctcttcaagcattttttgtgaaccatgtaaacaattgggtcacacgagcgtattgtgacaaggttcttcgcctctctgcggcaacacaagatttaccaaagtctgttgtatgcaatgtccatggtgtcaatcccaagttccttatgattggggagaaaattgctgaagagagatcccgtggtgaacaagctttctcaaaaggtgcatacttcttaggaaaaatggtgtgggctaaaggatacagagaactaatagatctgatggctaaacacaaaagcgaacttgggagcttcaatctagatgtatatgggaacggtgaagatgcagtcgaggtccaacgtgcagcaaagaaacatgacttgaatctcaatttcctcaaaggaagggaccacgctgacgatgctcttcacaagtaagttctgaaaaatgtgctttgcttttaaaaacttgttaaggtttcgctctttgattgtctttcccacatcttga

SEQ ID NO: 385 - DNA, 1576 bp, Arabidopsis thaliana
gaaagtggtcatctttgtctgtctctgtccgaaactcaggagccctaatctctgaatccatcaagaaagctctttctcttccttcttttatgcttctgaatttgctacatatataaactatctgaagaaagctagagaataagatgatgagtctaagtggaagtagcgggagaacaataggaaggcctccatttacaccaacacaatgggaagaactggaacatcaagccctaatctacaagtacatggtctctggtgttcctgtcccacctgagctcatcttctccattagaagaagcttggacacttccttggtctctagactccttcctcaccaatcccttggatgggggtgttaccagatgggatttgggagaaaaccagatccagagccaggaagatgcagaagaacagatggtaagaaatggagatgctcaagagaagcttacccagattcgaagtactgtgaaaaacacatgcacagaggaagaaaccgtgccagaaaatctcttgatcagaatcagacaacaacaactcctttaacatcaccatctctctcattcaccaacaacaacaacccaagtcccaccttgtcttcttcttcttcctctaattcctcttctactacttattctgcttcttcttcttcaatggatgcctacagtaacagtaataggtttgggcttggtggaagtagtagtaacactagaggttatttcaacagccattctcttgattatccttatccttctacttcacccaaacaacaacaacaaactcttcatcatgcttccgctttgtcacttcatcaaaatactaattctacttctcagttcaatgtcttagcctctgctactgaccacaaagacttcaggtactttcaagggattggggagagagttggaggagttggggagagaacgttctttccagaagcatctagaagctttcaagattctccataccatcatcaccaacaaccgttagcaacagtgatgaatgatccgtaccaccactgtagtactgatcataataagattgatcatcatcacacatactcatcctcatcatcatctcaacatcttcatcatgatcatgatcatagacagcaacagtgttttgttttgggcgccgacatgttcaacaaacctacaagaagtgtccttgcaaactcatcaagacaagatcaaaatcaagaagaagatgagaaagattcatcagagtcgtccaagaagtctctacatcacttctttggtgaggactgggcacagaacaagaacagttcagattcttggcttgacctttcttcccactcaagactcgacactggtagctaattaagtagagctggcatcaatgatggatctgcaccaacacacacaactgtgaaatgttgaagaagagtcacatttcacatctatttccgtggaacaatgagacaagacactgtttgcagaatcctatatgtattttttctatctttttctatgtgtgttaggtccaacaagaaaaagtgatccgacagatatatctgtatgtgttctcttgctttctcaagaaatcagattttatttta

SEQ ID NO: 386 - DNA, 1111 bp, Arabidopsis thaliana
gagttttaagcttcccaaagcgtttgttttatcctctcagagagctttctttagtgatggcggcgcttatccggtgttgctcctccttctctcatacttccggtggccaaccaccgccgcgtgacaagtctcgagctccagagattggaaaatttgctacatctattggctactcagtagtcagaaaacctggggatcatcctcctttctccaaaattatacattcgtcttcacagcctaaggagcgacaaggaaagggaatcttacaaacgccatttgccagtgtgggatctcttgacaagttttcagcttttgagggaattgggaggctcaaattaccggtgatggcagtgttgttgacaaactcccttcagatggctacacctcttgaagctttggctgctgagatatgtgagcctgagagctccatgttcagcatgcctattttgttgcttgttgctcttattggagccaccgttggagggttgcttgctcggcagaggaaaggggagttacagaggttgaatgaacaactacgacagattaacgcagctcttaggagacaagccaaaatcgagtcttatgcaccaagcttgagttatgctccagtgggagcaagaatcccagatagtgaaatcattgtggaaccaaagaaacaagagttgatttccaagttgaaaacaggaaaaacctttcttaggaaccaagaaccagagaaagcttatacagagttcaagatagctttggaacttgcccagagtctcaaagaccccaccgaagaaaagaaggctgcaagaggcctaggcgcctcgctgcagcgccaagggaagtatagggaagccatacagtatcactccatggttctagccatctcaaagagggaaagtgaagattctggaatcactgaagcatatggagctattgcagactgttataccgagctgggagatctcgagaaagctggaaagttctatgatacgtacattgctcggttagagactgactgatccttccgcaatgtttttttctttgttgtctgtttatgttcatgtaaaatcacatagaatggatatccaaatcccttttattgaatgtaattcgcttgtcttac

SEQ ID NO: 387 - DNA, 1927 bp, Arabidopsis thaliana
cttcatctctttggtctccttcttgcgttttctatttactacacagaccaaacaatagagagagactttaagctatagaaaaaaagagagagattctctcaaatatgggttagtccacaattttcactaaacctcttcttcttaggattgtttttagggttagggttttgaggtgaggagagcaagtatgcgggagtttcatcctttttgagttactctggattcctcaccctctaacgacgaccaccgtcgccgccgccgccgccgtctcgacgaatatgctctaccaatgtctgacgaccaattccatcacccgccgcctccttcttcaatgaggcaccgttctacgtcggatgcggcggacggcggctgcggcgagattgttgaggtgcaaggtggtcacattgttcggtctaccggaagaaaagaccgccacagcaaagtctgcacggctaaagggccacgtgaccggcgcgtgagactctctgctcacacggcgattcagttttacgatgttcaagacaggcttggtttcgaccgacctagcaaagccgttgattggcttatcaaaaaggctaagacttccattgacgagctcgctgagcttcctccctggaatcccgccgatgcaattcgcctagccgctgctaacgctaaacccagaagaaccaccgccaaaacccaaatctctccgtctccgccaccgccgcaacagcaacaacaacaacaacagcttcagttcggtgttggcttcaacggaggaggagcagagcatccgagtaacaacgagtcgagttttctcccgccgtcaatggattcagattcgatagctgacactataaagtcgttttttccggtgattggctcttcaacggaggctccttcgaatcataaccttatgcacaactatcatcatcagcatccgccggatttgctttctcgaactaatagccaaaaccaagatctccgtctctcgctgcaatcgttcccggatggtccaccgtcgcttctgcaccaccaacatcaccaccacacctctgcttccgcctccgagcctactctgttctacggacagagcaatccgttagggtttgacacatcgagttgggagcagcagtcgtcggaattcggaaggattcagagactagtggcttggaacagcggcggtggcggcggagcaaccgatacaggaaacggaggagggtttctgttcgctcctcctactccttcaacgacgtcgtttcagccagttcttggccaaagccaacagctttattctcagaggggtccccttcagtccagttacagtcccatgatccgtgcttggtttgatcctcaccatcatcaccaatccatctccaccgacgatctcaaccaccaccatcaccttcctccaccggttcaccaatcagcaatccccggaatcggattcgcctcaggtgaattctcttcgggttttcgcataccagcacggtttcagggccaagaagaggagcagcacgacggtctcactcacaagccgtcctctgcttcctctatttctcgccattgacaatcgaaactaatcctctaagtttcagcttccatgcacattgaagcttgacttagattgtccggaacagggaaggtgttctcggtttgtgtagtcaatggcctgaatctagaaaacgcaaggaaatgaagaaagaacaacagtttcaggttcttcttcttcttcttccaatatcttaaccttgccgattgtaatttttcatattttcaccagttagaccaacgttcttctgtagctcaattatggttagattccaaggtttcgtcttgttgtgttatgtttgtaactttgtatcatcatcatcctattgttactgctccctgttcttattgtgtaactccgtggatgttctaataaagtctgaaactttctctt

SEQ ID NO: 388 - DNA, 897 bp, Arabidopsis thaliana
ccatacccccaaagcccatccttcaacattgcttcctaaccagaaatccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatatctatccggaaatgtattcgcatagtcttgcgtctaataatgtttattgattttgtaggtttgattatatatgattgtaatgtgttttttac

SEQ ID NO: 389 - DNA, 2747 bp, Arabidopsis thaliana
atggcttgtcgtttccctctgcattcttcgtcaccttctcaattcctttcaccggaaaatcgtcagagactacccagaaattacccttcaatctcatgccaaaacaattcagctacgaacgttgtccatgaagatggtgatgataacgacaaagccaagacaaaccaagtcaatcttctcgcaataccaatcacactcactataatctccgcttctctagccaaaccgtcgttcgcggctgcgaaggtaacggagagaaagagaactcagaagaaacctcaggaggctttgacacttgaacagcttaaagcttggtccaaagatttacctgtagtttcgaatcgtataccttatactgacattttgagcttaaaagctgaaggtaagcttaagcatgtgataaagcctcctaatttaagtttgcggcaaaaggcagagcctgtgttagtagttttggaggattctagagtattaaggactgtgttgccttctttagagggtaataagaggttttgggaacaatgggatgagttagggattgatgtacaatgtgttaatgcttatactcctccggttaagagacctcctgtgccgtctccttatttaggatttttgtggaaagttcctgcttatatgttaacatgggttaagccaaagaaggagtctaaacgtgctgctgagttgaagagaatgagggaggatttcaagaggcagaggaaggaggagattgagacgatgaaagaggaaagagtgatgatggaaaagacaatgaaggcgcagaagaaacaacaggagaggaagaaaaggaaggctgttaggaagaagaaatacgaggagtctctgcgtgaggcgaggaaaaattatcgagatatggcggatatgtgggcaagattggctcaggatcctaatgtggctactgctcttggattggtattcttttatatattttaccgtgtggtggttctcaactataggaagcaaaagaaggattatgaagacaggttgaagattgagaaggcggaagcagatgagaggaagaaaatgagggagttggaaagggagatggagggaattgaggaagaggatgaggaggttgaggaaggtacaggtgagaaaaatccttacttacagatggcgatgcagttcatgaagtcaggtgcacgtgtgagacgagcatcaaataagaggttacctgagtatcttgagagaggtgtggatgtcaaatttacagatgttgctggacttgggaagattcgtcttgaacttgaggaaatcgttaagttttttactcatggagagatgtaccgcaggagaggggtcaagattccaggtggtattcttttatgtgggcctcctggggtcggaaaaactttactggcaaaagctgtagctggtgaagcaggagtcaatttcttctctatctctgcttctcagtttgtggaaatatatgttggtgttggtgcatctcgtgtccgagcattataccaagaagctagagaaaatgctccatctgtggtcttcattgatgaattggatgctgttggaagggagcgtgggttaataaagggttctggaggacaagaaagggatgccactcttaatcagctacttgtttctttagatggttttgaaggaaggggagaggtcatcaccattgcttccacaaacagaccagacattctcgatcctgcgcttgtgaggcctggacggttcgaccgcaaaatctttatccctaaacctggtcttattggacggatggaaattctgcaggttcatgctcgtaagaagccgatggctgaagatttagactatatggcagttgctagcatgacagatggcatggttggagcagagcttgctaatattgttgagatcgcggcaattaatatgatgcgtgatggaagaacagagttaacaacagatgatttgcttcaagctgcacaaatagaagaaagaggaatgttagatagaaaagacaggagcttggagacatggcgacaagttgcgatcaatgaagctgcaatggctgttgtagcagtgaactttcctgatatgaagaatatagaatttctgacaatcaaccctagagctggtagagaattgggttatgtccgggtgaagatggatcatatcaaatttaaggaaggcatgcttagtcgacaatccatcttggatcacatcactgttcagttagcaccccgtgctgcagatgaactatggtacggtgaggatcagttaagcacgatatgggctgaaacatcggataacgcaagatcagctgctcgatcattggttcttggtggtctttctgataagcatcatggcttgaataacttctgggtagctgatcgaattaacgatattgatgtggaggcattgcggatattgaacatgtgttacgagcgtgctaaagagattcttggaagaaacaggacgctcatggacgaggtggtagagaaactggttcaaaagaaaagtctaacgaaacaagaattcttcactcttgttgagctctatgggtccagtaaaccaatgccaccgagtatccttgaacttaggaagatcaaacggcttgagctagaagagatggtgctgaaactggacatgactaccgcaagaaacagttcataagatgattgtaatttggagaaaagagacagttcgtgacaatcgtagggaataaacatcaaaaacccattatagagacaatgaggttgatcctttatctatatttcctctgtaatctt

SEQ ID NO: 390 - DNA, 4426 bp, Arabidopsis thaliana
atggcggtttctgcaggggctttagcttttcctgctttatccgttcgcgccactcttaatcctgagattaaagatgaacaagcgaacatcagcagcactacttcttcttcccagaaattcacttacagtcgagcttctcccgccgtccgatggccacatttgaatctccgtgagatttatgattccacaccttcacaaactctttcttctccggtttctcccatcgccggtacaccggattcaggtgatgtcgtcgattcaattgcctcccgcgaggagcaaaagacgaaagatgaaaccgccgtggcgactcggagaaggagagtgaagaagatgaataaagtggcgttgattaaggctaaagactggagagagagagtcaaatttctgacggataagattctaagcttgaaatctaatcagttcgttgctgatattctcgatgctcgtcttgttcagatgactcctactgattactgcttcgtcgtgaaatcagttggtcaagagagttggcaacgagctcttgaggtttttgagtggctcaatctccgtcattggcactctcctaacgctcggatggtggctgctatactcggtgttttgggacggtggaatcaggaatcccttgcggtggagattttcactagggctgagccaaccgtcggagatagggttcaggtgtacaacgcaatgatgggggtttattcacgtagtggtaagttttcgaaagcacaagagctggtcgatgcaatgcgtcagagagggtgtgttccagatcttattagtttcaatactcttatcaacgctaggcttaaatctggtgggttgactccgaatttggctgttgagttattagatatggtgaggaattcgggtcttaggcctgatgctatcacttacaacactcttcttagtgcctgttcgcgggattcgaatttggatggtgcagtgaaggtttttgaggatatggaagctcatcggtgtcagcctgatttgtggacttataatgctatgatttctgtttatggaagatgtgggcttgctgctgaagctgagaggctcttcatggagctggagcttaaaggttttttccctgatgcagtgacatacaactctttgctgtatgcgtttgccagagaaagaaatacggagaaggtgaaggaggtgtaccaacagatgcagaaaatggggtttgggaaagatgagatgacatacaacacgatcattcacatgtatggcaagcagggacaacttgatcttgcgctacagctttataaggacatgaaaggtttgtcgggtaggaaccctgatgctattacttacactgttttgatcgattctcttggaaaagcaaaccgaacagtggaagccgcagctttaatgtctgagatgcttgatgttgggatcaaaccaactctgcagacatacagtgctcttatctgtggttatgccaaggctggaaagcgagaggaggctgaggatactttcagttgcatgttgcgctcaggcactaaacctgataatttagcgtattctgtaatgttggatgtattactaagaggcaacgagacaagaaaggcctggggtttataccgtgatatgatttctgatggtcatacaccgtcttacactctgtatgagttgatgatacttggacttatgaaggaaaacaggtcagatgacattcagaaaaccatcagagacatggaagaattgtgtggcatgaacccactagagatttcatcagtgcttgttaagggcgaatgctttgatctcgctgctagacagttgaaagtggctatcaccaatggctatgaattggaaaacgacactctattgtctatcctgggttcctatagttcatcaggcaggcattcagaagcgtttgagttacttgaatttttgaaagagcatgccagtggatctaaaagacttataactgaagctctaattgttctacattgcaaggtgaacaacttaagcgctgctctagatgaatatttcgctgacccatgtgttcatggctggtgttttggcagttccaccatgtatgagactctattacactgctgtgtagcaaatgaacattatgctgaagcttctcaggttttctctgacctgagactatctggctgcgaagcttcagaaagtgtttgtaaaagcatggttgttgtgtattgcaagcttggctttccagagacagctcatcaagtggttaatcaggctgagacaaaaggcttccactttgcttgttcgcctatgtatactgatatcattgaggcttatggaaaacaaaaactatggcagaaagcggagagtgtggttggcaacctaagacaaagtggacgaacacctgatctgaagacatggaacagcttgatgtcggcttatgctcagtgtggctgttacgagcgggcaagggctatttttaacactatgatgagggatggtccgtctcctactgttgaatccatcaatattttgttgcatgctttgtgtgttgatgggagactcgaggagctctacgttgttgttgaagaattgcaagatatgggctttaagattagcaaaagctccattctcttgatgcttgacgcatttgcccgagctggaaatatctttgaggtaaagaagatatacagtagcatgaaagctgctggttacttacccacaatccgcctttataggatgatgattgagcttctctgcaaagggaaacgagttagagatgctgaaattatggtctctgaaatggaagaggccaatttcaaggttgagcttgctatatggaattccatgctgaagatgtatacggctatcgaggattacaagaagacagttcaagtataccagaggataaaagaaactggactggaaccagacgagaccacttacaatactctgattataatgtattgtagagacagacgaccagaagaagggtacttgcttatgcagcaaatgagaaatcttggtttggacccaaaactggacacatacaagagcttgatctctgcttttggtaagcaaaaatgccttgaacaagctgaacaactgtttgaagagcttctctcaaaaggtttgaaactagaccgttcattttaccacacaatgatgaaaatatcccgagattctggaagcgactccaaggcagagaagttattgcaaatgatgaagaatgcgggaatagaaccaacacttgctacaatgcatctgcttatggtttcatatagttcttcaggaaatccccaagaagctgaaaaagttcttagtaacctgaaagacacagaagtggaactaacaactctgccttatagttcagttattgatgcttaccttcggagcaaagattataacagtggaatagaaaggcttttggaaatgaagaaagagggcctagagccagaccacaggatatggacttgctttgttagggcggcgagtttctccaaggaaaaaattgaagtcatgttgctgcttaaagctcttgaagatattggttttgatcttcctatcaggcttttagctggaagacctgagttgctagtttctgaggtggatggatggttcgagaaactgaaatccatagaggacaatgctgctctcaattttgttaatgctcttttgaatcttctctgggcgtttgaactcagagctactgcatcatgggttttccaattgggaatcaaaaggggtatcttcagtctcgatgtttttagggtggcggacaaggactggggtgcggatttcagaaggctgtctggaggtgcagcacttgatgcatcactggaaggctacccagagtctccaaagtcagttgtcttaatcacagggaccgcagagtacaacggtatatcccttgataaaacgctaaaggcgtgtctttgggaaatgggttctccatttcttccctgcaagacgagaacgggactgctagtggccaaagctcactctctcagaatgtggttgaaggactcgccgttctgcttcgacttggagctaaaagactcggtgtctttaccagaatcaaactcgatggacctgattgacgggtgtttcataagacgtggacttgttcctgcgtttaaccacatcaaagagagacttggtggatttgtgtcaccaaagaagttttcgagactggcgttgctaccagacgagatgagagagcgagtgataaagacagatattgaaggacatagacagaagttagagaagatgaagaagaagaaaatgggcaatgaaacgaatggtattaacactcgaaggaagttcgtcagaagcaagtgatgtcatgatattgtactctcttattataaaatctcattagtgattatttgtatacagacagttttgattttcctctttgtggatactaattagaataagtgttcatgtaatatttatcgatagggtttagtaaatt

SEQ ID NO: 391 - DNA, 3021 bp, Arabidopsis thaliana
gaaacttatttctcagtatccaaaacgatggcgaagaagacacttcgctgaagcttttttttccaaaaaaatttcttagtgtcgtcaatggctttggctccacttaattttacggaaatgccactgagaagctctcttcctctgacctctagctctcgctattgttcctctccttcgcttcacgcattgctcttctattcgttgggtgtgaaaccctcgcgtcaacaaattgttcggccattctcttcgctgcgtacaagcgagcgtagcaacaacaggagcaataacaatcgtcgattagatcaacgtaatcataaacctactcctccttggatagataagtggcctccgtcatcctccggagctggcggtgatcatgccgggaagaaaggtggtgaaaacaacggcggagatagaattcggtctgcggaggaggaagcggaagcgaaacttcggtatttggagaaggataaaggacaaaacgcgattgagaggattgttcttcggctacggaatttaggattaggttcggatgatgaggacgatgtggaagatgacgagggaggtggaattaacggcggagatgtgaagccggtgactggagaagagagattgggggatttgttgaagagagagtgggtgagacctgatatgatgcttgctgagggagaagagagtgaggaagaggatgaggtattattgccatgggagaaaaatgaggaagagcaggcggcggagagagtagtaggagaaggaggagtggcggtgatgcagaagaggagagctagagctccatcactggcggagctcaccgttgaggattctgagttacggcggttaaggagggatggaatgtatctgagggttaggatcaatataccaaaagctgggctaacgcaggcagtgatggagaagatttatgatacttggaggaaagaagagcttgtgaggctaaagttccacgaagtgcttgctcgtgacatgaagacggcccatgagattgttgagcgtcgaactggtggaatggtgatatggagggccggaagtgtaatggtggtttatcgtggacttgactataaaggacctcctgtgatctctaatcaaatggccggtcctaaagagactctttttgtcccagatgtatcttctgctggcgatgaagcaacaaatgccaaagataaccaaagtgcacctttggtaatcaaagatccgatcatcaagaaccctattcgcaaagagaatatgacagaagaagaagttgaatttaacagtctattagacagcttaggtccacgttttcaagagtggtggggtactggggtactacctgtggacgctgacttactacctcctacaattcctggttataaaacacctttcaggcttcttcctactgggatgagatcaaatttgaccaatgccgaaatgacaaatctcaggaagattggtaaaactctcccatgccattttgctcttggtaggaacagaaatcaccaaggattggcagctgcaatactccagatctgggagaaaagtctaattgcaaagatcgctgtgaagcgaggtatccagaatacaaataacaaactaatggcggatgaagtgaagacattgacagggggtgtcttgctgctcagaaataagtattacattgtaatatatcgtgggaaggacttccttccttcaagtgtggcagctactttagcagaaagacaagaattaacgaaagagattcaagatgtcgaagagagggtaagaaatcgtgagattgaggctgttcagcctgttggtgacaaagtaccagcagaagctggcactctggccgagttttatgaggctcaagcccgatgggggaaggaaataactccagaccatcgtgaaaagatgattgaagaagcttcaagggttgcaaatgctagagttgttaaacgaatacaacacaaactaaaccttgcccaatcgaagtttcaaagagcagagaaactgttgtccaaaatagaagcctctatgattccaaatggacctgattatgatcaagaggtcatctccgaggaagaaagagctatgttccggaaagtgggactgaaaatgaaggcatacttacccataggtatccgtggtgtatttgatggagtcattgagaacatgcatctgcattggaaacacagagaattggtgaagcttatatcaaaacagaagaaccaagcatttgttgaggagacagcccggttactagaatacgagagtggtggagttcttgtggcaatagaaaaggttcctaaaggatttgcgcttatttattaccgtgggaagaattacaggagacccattagcttgagaccaaggaatcttctgacaaaagcaaaagcattgaaacgttccattgcaatgcaacgccacgaggcacttagtcagcatatttctgaactggagagaacaatagagcaaatgcaaagccaactcacttcgaaaaacccgtcatacagtgaatcagaatgggagaacgatgaggatgatgatgatgatgaagaagaagagaaagatgatgtggaggataatgagagtgattgggatgaaactgatggcgaatctgcaatttctagtatcgaagaagctgatatgtcatcgcgctaagctgataaagtttttaacacagagattgtcctatctcaggaggttgaagctgacaatgatgtcagaggaatggttctggttctggttctgtctatccagtggtggtaaaagaaaagcaagtgatgattcatcatcaacgtgggtaaggtttaagtttcctgtcgcagagattacagaatctacgagctcagaaagcagaacctatctgtatttcaggggagaaaaaaataagcatctatagtttatatacattgtaagttttgccaatgtatcattattaaaaaatatatatatatcaattaacattcaacaaattgtaaattagttctactacctttgcttaagttctggcagcaattgtgatctgaaattctgaacaactagtaa

SEQ ID NO: 392 - DNA, 2019 bp, Arabidopsis thaliana
ggctggcttgaatcacgttttattataaagacaaatgctctcacactcttggggacactttcacatctcatcctctcactctctctctcctttggattcttcagtgaggagaggaaatgtcggatcttcagacaccgcttgtgaggcccaagaggaagaagacttgggttgattactttgtcaagttcagatggatcattgtcatcttcatcgtccttccattctcagccacattctacttcctcatctacctcggggacatgtggtcagagtccaagtcctttgagaaacgtcagaaggaacacgacgagaatgtcaagaaagtcatcaaaaggcttaagggtagggatgcttccaaggacgggcttgtctgcactgctcgtaagccctggatcgctgttggaatgaggaacgttgactacaagagagcccggcatttcgaggttgacttgggggagttccgtaacatccttgagatcaacaaggagaagatgactgctagagtggagcctcttgttaacatgggacagatttcccgtgctaccgtcccaatgaacctgtctctcgctgttgttgctgagcttgatgaccttaccgttggtggacttatcaatggatatggtattgaaggaagctctcacatctacggtttgtttgctgataccgttgaggcttacgagattgttcttgcgggtggagagcttgtccgcgccacaagggataatgagtattctgatctttactacgcaatcccgtggtcgcaaggaactcttggactccttgtagctgctgagatcaggcttattaaagtcaaggagtacatgagactcacttacataccagtcaagggtgatcttcaagccttagctcaaggttacattgattcttttgctcccaaagacggtgacaagtcgaaaatcccggatttcgtcgaaggcatggtttacaatccaacggaaggagtgatgatggttggaacatatgcatctaaagaagaggcaaagaagaaagggaacaaaatcaacaatgtgggatggtggttcaagccgtggttctaccagcacgcgcagaccgccctgaaaaagggacagtttgttgagtacatcccaactcgtgaatactaccacaggcacacaaggtgcttgtactgggaagggaagcttattcttccatttggtgatcagttctggtttaggtacctcttaggttggttgatgcctccaaaggtctctcttcttaaggccactcaaggtgaagctatcaggaactattaccatgatatgcatgttattcaggatatgcttgttcctctttacaaggttggcgatgcactcgaatgggtccaccgcgaaatggaggtgtatccaatttggctttgcccacacaaactcttcaagcagccaatcaaaggccaaatctacccagagccaggcttcgagtacgaaaacagacaaggagacacagaagatgcacagatgtacactgatgttggagtctactacgcacctggctgtgtcctaagaggtgaagagtttgatggatcagaagcagtgcgtaggatggagaaatggctgatagagaaccatggattccagcctcagtacgcggtgtctgagctcgacgagaagagcttctggagaatgtttaatggtgaattgtatgaggagtgccgcaagaagtatagagctattggaacgttcatgagtgtttactacaagtccaagaaaggaaggaagactgagaaagaagttagagaagccgaacaagctcatctcgaaactgcttatgccgaggcagattaagtaataataagccttggtttgatgtaatggctcgggatgattattgttattcctagtagtgtctgttatgttgttgtttcctaatttcagttttagtgtcttgaagactcttgttgttgttgtttgcttcttgttgttgtttgactcattctggtttgagtggattttagagtttaaaacttttggatttgcctatgaaattgaaggtttccggttt

SEQ ID NO: 393 - DNA, 1328 bp, Arabidopsis thaliana
agaagaaaaatagtgctttgagaagaagaaaaaaaccgttgccctagaattaaaatccacttctcagtgtcataggcgtcgtcggtttgggaattttataaagttggtctcttttgaattcatcagtttcgtcattctccttcaaatctggaaaccaaagcgagtgtgttttgctctcttgaatcgaattttgagcagaaaatggaagctctctacgccaagctctacgacaaatacaccaaactccagaagaagaaatattccgaatacgatgagattaataaggaacaagaagagaaattccttacctttgtttcagcctcagaggagttgatggaacatttgagaggtgaaaatcagagttctctggagatggttgagaagttgaggaatgaaatcatttcaatcagatctggcagggacgacaagtttctggagtgtcaaaagcttctcatggaagaagaactaaagaacaaatcactttctgaagaagttgtcaagctaaaagagctggtccaagaggaacatcctcgcaactatgaagatcaaagtggaaaaaaacaaaagagaaagactcctgaaagtgctcgagttacaacgagaagcatgataaaacgtagcagactgtcagaagatttggtggaaacggatatggtatcacctgacattagcaaacatcataaagcaaaggagcctctcttggtttctcagccacaatgctgcagaacaacctacgatggatcaagtagttctgctagttgtacatttcaagctcttggcaaacacttgctaggaatgaaattatcaactaataataagggcaaacgcgcctgcattgtagcctcacacccaacaaccggtttatccttcagcctaacttttataaataacccaaatggtgaagaatctgagctgctttacaagcctgcatcactcggaacatttcaaagagtggcaccggaatggatgagagaagttataaagttcagcacaagtatgtgtcccatcttctttgaaagagtctctcgagtcattaagctcaattgttgatcggtaccgtatgtacatctccctccccttatcttgtgtagtcatctctgatggcttcttagtgtgatgtttctcaataggtttgaaaagctagggaagttatcattgtatctatagaaatgtgtctctctttaactttggaattagtttcaaagatagtgtgtccttgtgatgaatcatattgtaacaagatcttgatttatcctttgctctcgataccctctcctcttgtagacctcataaatctctgatctattgagcattttacatgattcaac

SEQ ID NO: 394 - DNA, 3088 bp, Arabidopsis thaliana
atcttaaaaaaagactaaaaccctgagtgtgagtgagagtatgaacaaatcttcttcgtagcaccaacaaaaatggtgtccctctctaatcaaaccagattctctttccacccaaacaatcttgtcgtttccgagaaacggcgcctgggaatctcaggagtcaattttcccaggaagatcaagttgaaaatcacttgcttcgccgccgagagaccacgccaggagaaacagaaaaagaagagtcagagccagagcactagcgacgctgaggctggagttgaccctgttgggtttctcaccagactcggaattgctgacagaatctttgctcaatttctccgggaaaggcataaagctttgaaagaccttaaagatgagattttcaaacgccatttcgatttcagagattttgcttcaggatttgagttattggggatgcatcgacatatggaacaccgggttgactttatggactggggtccaggttctcgttatggggctataatcggagatttcaatggatggtcgcctacagaaaatgcagctagagagggcctatttggccatgatgattatgggtattggttcattattcttgaagataagttaagagagggtgaagaaccagatgaactatactttcagcagtataactatgtcgatgactatgataagggtgatagtggtgtatcagctgaagaaatcttccagaaagctaatgatgagtattgggaacctggtgaggatcggtttattaaaaaccgctttgaagttcctgccaaactatacgagcagatgtttggcccgaacagtccacaaacgttagaagagcttggagatataccagatgcagaaacgagatataaacagtggaaagaggagcataaagatgacccgccaagtaatctacctccatgcgacatcattgataaaggtcaaggaaagccatatgatatttttaatgtcgtgacatctccagaatggacaaagaaattttatgagaaagaacctccgattccatattggttagagacacgtaaaggaagaaaggcatggttgcaaaaatatattccagctgttccacatggaagcaagtatagattgtatttcaatactcctgatggaccgcttgaacgagtgcctgcttgggctacatatgtgcaaccagaggatgaaggaaagcaagcttacgcaattcattgggaaccttctcctgaagctgcatacaagtggaaatattccaagccaaaagttccagagtccttgcgcatatacgaatgtcatgttggaatcagtgggtccgagccaaaagtttcaactttcgaagaatttactaagaaggttacgaacttctttgctgccagtagccgatatggcacgccagatgatttcaaacggttggttgatgaggcacatggcctaggacttcttgtctttttggacatcgtgcattcttatgcagcagctgatcagatggttgggctttctctcttcgatggttcaaatgattgctattttcattatggtaaaagggggcatcacaaacactggggcacccggatgttcaaatacggtgatttggatgttcttcattttctaatatcaaatttgaactggtggattacagagtatcaagttgatggttaccaatttcactcgcttgcctcgatgatttacacgcacaatgggtttgcttcatttaacaacgatttggatgactattgcaatcagtatgttgaccgagatgctctgatgtacctcattttggccaatgaaatcctgcacgttcaacatccaaatataataacaattgctgaggatgcaacatattaccctgggttgtgtgagccagtttctcaaggtggacttggatttgattattatgtgaatctttctgcgtcagaaatgtgggtttctctcctcgacaatgtaccggataatgaatggagcatgagcaagattgtcagtacattggtggctaacaaagagtatgcagacaagatgctcagctatgccgaaaatcacaaccaatccatatcaggagggcgttcatttgctgaaatcttattcggtggagtcgataatggttctcctggaggaaaagaattgctagacaggggaatttcactacataagatgattagactgattacttttacaagtggtggccgtgcatacctcaatttcatgggaaatgaatttggacatcctgagagggttgagtttccaacgcagagcaataacttctcgttttcacttgctaaccgccgctgggacctgctggaaagtggagtgcatcatcacttgttttcctttgacaaggagctaatggacttggataaaagcaagggtatcctttcaagaggtctgcccagcatccaccatgtgaatgatgcaaatatggtgatttctttctcaaggggtcctttcctatttatctttaacttccacccatcaaattcatatgaaaagtatgatgtcggtgtagaggaagctggtgaatataccatgatactgaactccgatgaagtaaagtatgggggtcaagggattgtaacagaagaccactatcttcaacggtcaattagcaagagaattgatggtcaaagaaattgcttagaggtgtttttgcctagccggactgcccaagtttacaagttgacccggatcctccgaatatgatcctctctctttgtatgccacatacaaacaccaagcatgtttgtctgagaggctaggtatgaacccaaggtcactacaagaggtgatgtaatattaacatggctcgtccaagcgatgatggcagttaagaagattatcaatcacgccttcacagaggtgcaataaaagaacaagcagttcataaagagaatcccaggaagaccaattcatctcgtggtgtagttcaagcaaacaaatgttttgtatcaaatcagctgcatcatgtaacgagaagttaacacatgaacctcttaatggtgtaggccgactgatgttatgtagtaaatttctaggaggtgctcaagtttgtgtatttaagaaatctttggtagttggtatatatagttttgttaatgcatttctcgac

SEQ ID NO: 395 - DNA, 2212 bp, Arabidopsis thaliana
ggaaacttgtagtgttgtactctgagacatttggtttgatctgactcaaattttcacaatttgttgttgtttcaatggcgggtgatgatttagttgaaacgaagaagggaagctcgaagaactctaaggacagcaacgagagcaagctcaagcaaaaatctccagctgagtttttcgcggagaacaagaacattgctggatttgataatccagggaagtcgctttatactacagttagagagcttgttgaaaatgctcttgattctgcagagtctatttcagagctccctgaggttgaagtaactatcgaagagattgtaaaatctaagttcaactccatgattggtcttatcgatcgggaacgtgttgacacacagctgtatgatgattatgagacagaaaaggcccgtgggaaaaggttagcaaaggaagctcgagccagtgagatacaagctaaaaatttggcatcgggaaagaaaaacaaagagcctggagtatcgaaggttttaaaggcccgtggggaagcctcatattacaaagtgacatgtaaggataatggtaaggggatgccacatgatgacattccaaatatgtttgggagagttttatccgggacgaagtatggactgaagcaaacacgtggaaagtttggtctgggtgcaaagatggccttaatctggtccaaaatgagtacaggtctccccatagagatctcgtcatctatgaagagccaaaactatgttactttctgcagactggatattgatattcacaggaacattcctcatattcatctgcacgaaaagaagggcaacaaagagaaatggcatggggctgaaatacaggtggttatcgaaggaaactggacaacatacagatcaaagatcttgcactatatgcgccaaatggctgtcattactccttatgcgcagtttctgtttagatttatatcagagacaccagagaaaaatgtcactattaagtttactcgaagaacggatgtgatgccccctattcctatcgagacaaagcaccatccatcgtcagttgacttgctgcttatcaagcgccttattacagacacttccaaaaagacccttctgcagtttcttcaaaatgaatttgtgaatattaacaaaacccttgcagcacgattaattggggaaatgggacctgatttcgggcctagcatggctgtcaaatctgtgacatctcagcaaatggtacgcatacatcagttattccgccaagctaaattcgacgaccctagtggtgattgtcttagcccagcaggagaatacaatcttcgtctagggattattaaggagctacatccagatatggtggcaacgtattccggcagtgctcaggtcttcgaaggtcatcctttcattgttgaagctggtgttagtttgggtggaagagacgtgaaacaggggatcaacatattccgttttgcaaaccgtattcctctcctttttgaacaaggagctgatgttgtcaccaggacggccttaaaaagaatcaattggaatagttataagatcaaccagacgcaagataaaataggagtatttgtgagcatagtgagtacaaaaattccattcaaagggacagggaaagagtacataggagatgacatcagtgagatagctactgcagtcaagtctgcaattcaacaatgctgcatccaactgaaatccaaaatagtcaagagactgcaagcccgtgaacaacaagagcgaaaacgcagtttgagcagatacatccccgatgcaacgggggcagtgtacgaggttctaaaacaaatgacagaagaacataaaacaaagagaaaacgttacggagaggaagacatagttatgcttgataaagtatctaaacagataatcacaaaagaaacattgaaagaaaagctagctgagcatgtagaacaggtggactacgagatggcattagagtatgcaacacaaagtggagtaagtgaagaacccagagaaaatatatatctccaacacttagatcccaacaaatccaacttcatagatcttcatagtccaacttttgtcttcaggctcatgttgtaaaacatatttgcatctctctattagtcaattcttttctttcagtgttttttgggatattttaagacaaacacttgaaaagtggaaaaaagaagacataaaatttaacactatgtttggttagtttc

SEQ ID NO: 396 - DNA, 1342 bp, Arabidopsis thaliana
aaaagtcgaagggtctctttatattttcagaatcaaaatctgaaatttatctctcggtcgatccagtcttcgtgagtgacttcgacgacgacgacgagtcacactactcttgagcttctcatacttcacccaggttgatttgggaaataatggatgaatctctggagcatcaaactcaaacacatgaccaagagagcgaaatagttactgaaggaagtgccgttgtgcatagtgagccatctcaagagggtaatgttcctcctaaagttgatagtgaagctgaggtcttggatgagaaagtcagtaagcagattataaaggaaggtcacggttccaaaccatccaagtactctacatgctttttgcactacagggcatggaccaaaaactcgcagcacaaatttgaggatacatggcatgagcagcaacctattgaattggttcttggaaaagagaaaaaagaactagccggtttagccatcggtgttgctagcatgaagtctggtgaacgtgcgcttgtgcatgttggctgggaattagcttatgggaaagaaggaaacttttcttttccgaatgttccacctatggcagacttgttatatgaggtggaagttattgggtttgatgaaacaaaggagggaaaagctcgcagtgatatgactgtagaggaaaggattggtgcagcagacagaagaaaaatggatgggaattctctttttaaggaggagaaactggaggaagccatgcaacagtatgaaatggccatagcatacatgggggacgattttatgtttcagctgtatgggaagtaccaggatatggctttagcagttaaaaacccatgccatcttaacatagcagcttgcctcatcaaactaaaacgatacgatgaagcaattggtcactgcaacattgtgttgacagaagaagagaaaaacccaaaagcactgttcagaagagggaaagcaaaggcagagctaggacagatggactcagcacgtgatgatttccgaaaggcacaaaagtatgctcctgacgacaaggcgattagaagagagctacgagcacttgcagagcaagagaaagccttgtaccaaaagcagaaagaaatgtacaaaggaatattcaaagggaaagatgaaggtggtgctaagtcaaagagccttttttggttgatagtgttatggcaatggtttgtttcccttttctcccgtatctttcgacgccacagagttaaagcagattaatgtatgaagaagggtaacaattcaactctaaaagaccaacgtgaaagatctacccccatttcttattagtgagaattttgaaaaatattttatat

SEQ ID NO: 397 - DNA, 1851 bp, Arabidopsis thaliana
tcaattcatcatcctctgttttgtaaccaatctcagctctccctctcaaacaatccaggattcttcagattcctctcctttgatcctctctttaacaatctctctctctctgttttcttcgatccgttgtaggagaaaatggtcgttatcaacagtctccgacgcttggcgcgtaccactcaggttcatttgcacagtaagtatgccacttgcatgtctgggaactccacttccaggaggattttcactactgaggcagcacctgagaagaaaaacactgttgggtctaaagggcatgatatgcttgcaccttttactgctggatggcagagtgctgatttagatcccttggtcattgcaaagtctgagggaagttatgtgtatgatgatactgggaaaaaatatcttgactctctcgctggtttatggtgtactgccttaggaggaaatgagccaaggcttgtttctgccgctgttgaacagttgaacaccttgccgttttatcactccttttggaaccgtactactaaaccttctctggatcttgctaaggttcttttagagatgttcacggccaacaaaatggccaaagcattttttacaagcggtggatcagatgccaacgatacccaggtcaagctggtttggtattacaataacgcacttggaaggcccgagaagaaaaagtttatcgcgagaaagaaatcgtaccatggctccactctaatatcagcaagtttgtccggccttcccccgctacaccaaaattttgatttacctgcaccatttgtgttgcacacagattgccctcattattggcgttttcatcttccaggcgaaacggaagaggagttctcaaccagattagccaagaatttagaggatctaatcatcaaagaaggaccagaaactattggtgcttttatagctgaaccagtcatgggtgctgggggtgtgatacctccacctgctacctactttgaaaaggttcaagctgttgttaagaaatatgatatcttgttcattgctgatgaggtgatatgtgcatttggaaggctcgggacaatgtttggctgtgacaaatacaacattaagccagatcttgtgaccttagctaaggcactgtcttcagcatatatgccgattggagccattcttatgagccaagaagtggcagatgtcataaattctcatagcagcaagctaggcgttttctcccatggatttacttattctggtcatccagtttcgtgtgctgtagcaattgaagcgttaaagatatacaaggagaggaacataccagagtatgtcgccaaagttgccccaaggtttcaagatggagttaaagcgtttgcctctggtagtcctattattggagagacaagaggaacaggtttgattcttgggactgagtttgtagacaataaatctccgaacgaaccatttccaccagaatggggtgttggcgcattctttggagccgagtgccagaagcacgggatgttagtccgtgttgcaggtgatggcattttgatgtctccaccgctcattatctcacctgaagagattgatgagttgatttctatctatgggaaagcattgaaggcaacggaagagaaggtaaaagaactcaaggctcagcacaagaagtgaaaagcagagtcaaaatgatgttgatgaaaaatgttttttagattctcaaagtttggatcctttgtttttttttttaacacacaacaagtctttaaataagtacattttaatgaggaataaacaataatgggacaacatctgacgatgtgatcaagatcatctactaaaccaaaaatgcagccatagttaacaataacc

SEQ ID NO: 398 - DNA, 2415 bp, Arabidopsis thaliana
acactgtttcgcaccggcgcggacaaagttttttttttgttcgaaatccgacaacaaccctagattataaacaaaataaaccagtgtctgcatagaggcaatgtagatgtgatttttgctggaaaatggacaaatcccagaagaatcctacttcccagatcggaacttcaactcccaaatccaaattcgaggattctccagtgttcaactacataagcaacctctctccaattgagtcggtcaaatctatctccactgctcaaacgtttagctctcttagtttcacatctcctcctcctgtgtttacttctcctcacgtcatttctcacagagaatccagattcttcagatgtcataactctgttgatcgttcaaagcacttagaatctttagatggatctgctgttaaaggagaagttgtagtaccattagttgaagatctaaataaagaagcttctttggaagatgaagaagaaacttctgttgaaacgtcttctgagctgccacagatcatgaagttcgatagccaaacttctgagcatagtgattcaccttgcactgaagatgttgttattgaagcttcatctgatcctcctcgaggagacaatggttcgtcatccgaggatgtcacgatgggacttcagaatatgcttgttgttcgggaagggaatgacactcctggttgtggacgtttgatctcagatgcaactgagctgttagtatttcgatctccgaatgattctgaggcttttagatgcttggtcgataaaatatcaagctcagaaagacggttctgtgctggtgtcaagtctacaaagcggcctgatatcaacaaagatattccagccaatggatctagtaatgaaaatcagcctttggctgtgcttcctacaaacgagtctgtctttaacttgcatcgtggtggcatgcgaagacgctgccttgactttgagatgccagggaaacggaagaaggatattgttgatgatcagcaatctgtgtgtgacaataatgtggctggtgaatcttcctcgagctgtgttgtacctggtattggtcttcatctaaacgccgttgcaatgtctgcaaaggacagtaacatcagtgtcatacatggctattccatatctggagagattcaaaagagtttctcaggctctaccactccaattcagtcccaagacactgtgcaagaaacttcggaccaggcagaaaacgaacctgtagaagaagttcccaaagcattggtgttcccagagttgaatctaggcagccttaagaaaaagatgcgtaaatctgaacaagctggggagggtgagtcatgtaaacgatgcaactgcaaaaagtctaagtgtttgaagctttactgtgaatgctttgctgctggggtttattgcatagagccatgttcatgtatagattgcttcaacaaacctatccatgaagaaactgttttggctacccgcaaacagattgaatcccgaaatccacttgcatttgctcctaaagtcatcagaaatgcagattccatcatggaagctagtgatgatgccagtaaaaccccggcttctgcacgacacaaacgtggctgcaactgcaagaaatcaaactgtatgaagaaatactgtgaatgctatcagggtggagtcggctgttccatgaactgtagatgcgaaggatgcacaaatgtattcggcagaaaagatgggtctttacttgttatcatggaaagcaaactagaggagaatcaggagacatatgagaaaagaatagcaaaaatccaacacaacgtcgaggtgtcgaaagaagtggagcagaacccaagttctgatcaaccttcgacaccactgccaccgtacagacatttggtggttcatcagccattcttgtctaagaacagactgcctccgacacagttttttcttggcacaggttcttcctctttcagaaaaccaaacagtgatttggcgcaatcacagaatgagaagaagcctcttgaaactgtgactgaggacaaaacagagattatgcctgagattctcctcaattcccctatagctaacatcaaggccatctctcccaacagcaagagagtctctccccctcaacccggctcctcggagtcaggctcaatcctaaggagaagaggtaatggccggaagctgatactacggtctattccagcatttccttctctcaacccaaatcagtgaatcaaaaacaatttggttaagctatggaaaaattctttgtatctttgtaatgttccagatcctattagcctatcattgtttccataacataaggcataagcaacgttattgtaagatactttattctagtagtagtaggtaatgtaatagtacattctagttcataatcttccagaaagaacgtcctaaactggactttgag

SEQ ID NO: 399 - DNA, 1376 bp, Arabidopsis thaliana
gagcaaagattttcaaatttcgaatttcaaaattctatctctctcactcttccaagcttagagactcttagagcgagaaaatgatggcttctcttaaagctgaagaaacgagccagatgcagctcgttgagcgtgaagaaaatgatgaagacgaagatctatttgagatgattgacaaattgatcgcacaaggtataaacgcaggagatgtgaaaaagctacaagaagctgggatccatacctgcaatggtctcatgatgcataccaagaagaaccttactggaatcaaaggtttatctgaggccaaagttgacaaaatctgtgaagctgctgagaaaattgtgaactttggatatatgactggaagtgatgctcttataaagaggaaatcagttgtaaaaatcactacagggtgtcaagctctcgatgatctcttaggaggtggaattgaaacctcagccatcacagaggcttttggggaatttaggtctgggaaaacccaattagcacataccctttgtgtcactacgcagctacctacaaacatgaaaggagggaatggaaaagtggcatacattgacacagagggaaccttccgtcctgataggattgtcccaattgctgaaagatttggaatggatccaggagctgtgcttgacaatatcatttatgctcgtgcttatacctatgagcatcagtacaacttgcttcttggccttgctgcaaaaatgtctgaggaaccatttaggattctgattgttgactcgatcattgctttattccgagtggatttcactggaagaggagaactcgcagaccgccagcaaaaactagctcagatgctttccaggctaatcaaaattgcagaggagttcaacgttgctgtctacatgactaaccaagtcatagctgacccaggtggtggaatgttcatatcagacccaaaaaagccagcaggtggtcatgtactagctcacgcagccaccatcaggctcttgttcaggaaaggcaaaggcgatacacgtgtctgcaaagtctacgatgctccgaatctcgctgaagctgaagccagtttccagattactcaaggaggcattgctgacgcgaaggattagaggagcgaactcttttatatgtcataatcacgaattatgtctgttcttaacttgctgcttgtttctgcatcgaatcagacgttttaattaagtctttttattcttagtttcttgtttaccaaataagacgatcattacttgattcggcttacaaaaccaatctatgtatctgataaagctgcaaacaaaacaactctggttcgtttgtaaaaagacaataatggctttataacaagtaacaagtaaaagttcattatgatc

SEQ ID NO: 400 - DNA, 2133 bp, Arabidopsis thaliana
gagttcgctcgttcgtaaatggcgcgaggtctgtctctatgctccaatggaagaaagtcttcgactttactctcaaactccatccctagggtttcaatttccttttctcctaaaacccttttcacttgttcatatccacttcaatcccgccacccaaaattctcacaacgattgttctgtaatcacgcctgtgtcccggagactgtggacgaaacgaggtacaaggagcttttcaataagagaatggatatggcaggacttaaacctcacaaccgaattgctttgggagtttcaggtggtcctgatagtatggctctttgtgttctaactgcaaaatggaaaactgaaggattaagttgtgttaataagacagatggttttattgatggacttgttgctatagttgttgatcatggattaagacaagagagtaaagatgaagctgaacttgtctgttctagagtttctcaaatgggaatcagatgtgagattgcaagttgtgattgggttgatggtagaccaaagcttggccacttgcaagaagcagctcgtgaaatgaggtatgagatgatttcgaatgtgtgttttcgacaacagattgaggtcttgcttatagcgcatcatgcagatgaccagttggatgcaggctgagttattcattctcaggttatctcgtagtagcggtgtacttggtcttgcgggtacagcttttgcttccgagattttctccagaaatctgcagttagatgcaaaacatatgaagaaccaatctattcgcttagtgcgtccgctactagatttatggaaagaagacatgtacaagatatgtcaatggggtagacaagattgggttgaagatccaactaatcgtagtcagttgtttgttcggaataggattcgaacatcaataggaaatctagaatcaggtagcttcaagtcagagctgcaagcagtcatttctgaatgcaggagaacacgttcatttgttgataaagtttgtacagacttaatacatcagaccgtaacagtgacagataaagggtatgctattcttgatctagagagacttaatccttcaggagttaaagacatttgcctctcaaagtatctctttgcggtcctgcagtttatctctcaacggcaaagaccaatcagaggaaacacttcaaagttgcttttgaactatatccgcgcaattccgtgcaggacatctctaacagctgctggttgctaccttagtcctgctccagggtcgaagggtaccaaaattatagtctcatgttctgttgactgtcctttaccatcaaagacagaactcttgaacatttccttcaatgaaactccatctgatgaccttggacaaatcatagcagacgcaaaatcgttttctgaccatgtggctccaaccagcttgtttgaagtccagtttctggatgttgcatctgaatccgtattgagtaaagccagagagctcaatcttctcagcgaatcgacgtatacaaccattggtctactgcagagggatgaaactaaacggtttttaactaaaacagaagagaaatcagtggaattagagcatggaaccaacattgcagcttcctctgataaagtacatctttgtctagggcaaaatctctacttcatgaaccgttttctcatcagatggaacctaagtgaccaccaatgtaatgaagcagactgcagaaattgtccagtgagtactgctacatcaatggaggttcggcacatggttgaacccgactggttatatctagctgagctttcaaaatgctcaacctcaaatcattctatttcatcctcacaaaaagctctcaggtccttaaagttgatcccagccgctgcaagaaaaagccttcctgtcttggtcaatcactgtggattactactctgcataccagctattggcttcagttattgttcatgccttgaggcatctgcagtgtttcttccaagaataccactcggaggcggtcatagctcatttctctagtctagccatatcatgttgcattcattcaatactaacagacatttattcacttgtactgaattctcgtgaaacgaaataatatttgattcaagaatctgtatcctaggcaacttccgttattg

SEQ ID NO: 401 - DNA, 626 bp, Arabidopsis thaliana
atgtcgtataattcttacgccgagatgagttatcttctgaagacgttaacgacgaaggaagagattgatcgggttatcagagacaccattgatgaagttcttgttttacgatttggtcgttcctccgacgccgtttgtcttcagcatgatgaaatccttgcgaaatcggtgagagatgtttcgaaatttgctaaggtagctttggttgatgttgattcagaggatgttcaagtgtatgtgaagtattttgatatcacgttgtttccttcgacgatcttcttcttcaatgcgcatcatatgaaattggattctggaactgcggatcatactaaatgggttggtgcatttcatataaaacaagactttattgatgttgttgaggctatatatcgaggagcaatgaaagggaagatgattgttcaatgtccaataccgccagagaggataccaaagtaccagctcgtgtacaaggatgtgtagacactaaagtttgttgtgcttacaatgcaaaatctgtttctcatcttctgtgttggcaataatatttacatttgacattttgagatttacagttatgtttttgtacaaagttgaagaatgagaataaatatgcagatttttcgata

SEQ ID NO: 402 - DNA, 1074 bp, Arabidopsis thaliana
atttccgaggaagactagccgttacgctcttattcctttttttttctttttctttctttccttctttttaatccttccctcaaatatctttttttcccttcaaaatcattaaaaccctaagcgacgctgttaacacttgcgaattcaattttcaaaatcaccgatccttagactccatggcgtccaaaacagcggctgctaaagatatcatcactttacacggatctgctgccatcgtcagcgaattcttctgttacgctgcgaacagtatattgtataatcgtgcagtttatccagaggaaagttttgtgaaagtgaagaaatatggacttccgatgttgcttattgaagatgaatccgtcaaatctttcatgtctaatctcacttctcagatctccgaatggcttgaagctgggaagttgcagagagtagtgttagtgattatgagtaaagctactggtgaagtcttggagaggtggaattttcgtattgagactgataatgaagttgttgacaaaggtgtgtcgagggagaagagtgataaggagatcatgagggagattcaagctattatgagacaggttgcttcaagtgttacttacttgccttgtcttgatgaaacatgtgtgtttgatgtattggcgtatacggatactgatgtggctgttccattcacttggatcgagagcgacccgaagttgattgctaatccacagatggttaagttacacggttttgataccaagattcacaaagtcgacacgcttgtctcatacaagaacgacgagtgggatgaagaagagtaacagaagtcgggacacacgtatgcaaggctctttgttcagcttgcgtttatctctttgggagttctcattgttcttaaaggcacgtgaatcctttattcacacacctatatcgttttctcttctgttttttttctttttctgaattgtatgagaattggaatcctgtacttgtgttgtgttttgttcaaaagttatcagctttttcattgtccctgtctcttgtactgaaccgttttgtttaccaatcaaactttatggctcttggatc

SEQ ID NO: 403 - DNA, 687 bp, Arabidopsis thaliana
atgagaataaggagaagagatgaaaaagagaatcaagaatacaagaaaggtttatggacagttgaagaagacaacatccttatggactatgttcttaatcatggcactggccaatggaaccgcatcgtcagaaaaactgggctaaagagatgtgggaaaagttgtagactgagatggatgaattatttgagccctaatgtgaacaaaggcaatttcactgaacaagaagaagacctcattattcgtctccacaagctcctcggcaatagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttag

SEQ ID NO: 404 - DNA, 2095 bp, Arabidopsis thaliana
gtatcttcttctccttcctcagccacagaacaagctttgattcatcatttctgcgaaaagaacagagctttggcttggtttcgtgtcttaggtactggttcttacgtagcttatgttctttgtttaaggaaatttaggggttgtttgcttagacttgaagtgggtattactaaagttgtcaactttttgttgaataggaaatggtttctcagatttcgtctgaattatgctaaaagatcaagttctctctgctcggtgttgaaattggaggtgttagagattgctgcgtttagctcttcactgtattatcatgggagctgtctggttgagtcatgtctctcaattggtttgtggatgttatttaattgagcagagctcttgtgttttgagaacttttcattggtctttgagtcactcattgaactttacattgaccatgaagcctaaacgaaggcgtctaggtgtaaaaatggagtctttttctttggcaacaccaaacatgtgtttcaggaaggtgagtagtgaattagacagttctttcaacggtgaaaatgtggtttgtggtttggaactggaggagaagactgcaggggataggaataggatacattttctagaggagcggaacgaagaaactttatcgaagaggcttcggaaacttagcaggttggataaagtcagaagcgcattggagttgtttgattctatgagattcttgggtttacaacctaatgctcatgcctgtaactcttttctctcgtgcctcttgaggaatggagatattcagaaagcttttaccgtctttgagttcatgaggaaaaaggagaatgttacagggcacacgtatagtttgatgttgaaagctgttgcagaagttaagggttgcgagtctgcattaagaatgtttagagaactagaaagggagccgaaacgtaggagttgttttgatgtggttctatataatactgcgatttctctatgtggacggataaataatgtgtatgagacagagagaatatggagagttatgaaaggtgatggtcatattggaacagagattacatattctctgcttgttagcatttttgttcggtgtgggagaagtgaattggcccttgatgtgtatgatgagatggttaacaacaagatatctctgagagaggatgcaatgtatgcgatgataagtgcgtgtacaaaggaggaaaaatgggatttggccttaaagatatttcagagtatgttaaagaaagggatgaagcctaatcttgtagcttgcaatactttgataaactcgctgggaaaggcgggtaaagtcggattggtgtttaaggtttacagtgttttaaaatccttggggcataaaccagacgagtacacgtggaatgcgctgctcacggctttatacaaagcaaaccgatatgaagatgttcttcagctgtttgatatgataagaagcgaaaacctgtgttgtctaaatgaatatttgtacaacacagctatggtgtcatgccaaaagcttggttattgggagaaagctgtgaagcttttgtatgaaatggaaggttcgggtttaacagtttcaacttcatcatataatctagtgataagcgcttgcgaaaaatcaagaaaatcgaaagttgcattgctagtatatgagcacatggctcaaagggattgtaagccaaacacgtttacttatctttcgcttgtaaggagttgtatttggggttccctttgggacgaggttgaagatatccttaagaaagtggaacccgatgtatcgctttacaatgcagctatacatgggatgtgtttgagacgcgagttcaagtttgcaaaagagctgtatgtcaaaatgagagagatgggtttagaaccggatggcaaaacccgagctatgatgttacagaatttgaagaaacaccaaaaataaggttataattgtacgttatctactcatacttatttgcatttgccaactgccaagtatcataagtcaaaattcactaaaacaattggtctgtaattaggcattgtatgcatactcactgtgatgaatgttctggtgatggtgatgtttgtttgataaatgagg

SEQ ID NO: 405 - DNA, 1474 bp, Arabidopsis thaliana
aaaccgattcatttaaacaacaaaaaaccacttacagagttcgttcgccggcggcggcgagtcatcgtcatcaatgtcaaacatcgttgttctagacaacggcggtggtctaatcaaagccggacaaggcggcgagcgtgatcccaccaccgtaatcccgaactgtctctacaaacctctctcttccaaaaaattcatccacccatcaccactcaccactctctccgacgaaatcgacctcacctccgccgccgtacgccgcccaatcgaccgtggctacctcataaactccgacctacaacgcgaaatctggtcacacctattcacttccctcctccacatagctccttcctcctcctctctcctcctcaccgaagcaccactctcaatcccttccgttcaacgaaccaccgacgaactcgtcttcgaagatttcggattctcttctctctatatagctcatcctcaatctcttgttcatctctatgaagctagtcgtcagcctgattcaatcctctcaaagactcagtgtagtctcgttgttgattgtggtttctccttcactcacgctgttcctgttcttcacaatttcactcttaatcacgccattaagaggattgatttaggaggaaaagcttttactaattacttgaaggaattggtttcttatagatctattaatgttatggatgaaacttttttagttgatgatgctaaagagaagctttgttttgtttcacttgatcttcttcgtgatctccgccttgctagaaatgggaacactcttatcaagtctacttatgttcttcctgatggtgttacacataccaaaggctatgttaaagaccctcaagctgctaagaggtttcttagtttgtcagagaaagagtctgtggtggtgatggataaggttggggagagaaagaaggctgacatgaacaaaaatgagattgatttaacgaatgagcgttttcttgtacctgagacgttattccagcctgcagatttagggatgaatcaggcgggacttgcagagtgcattgtccgagctataaactcatgccattcttacttgcaaccagttttgtatcaaagcattatcttaactggtggaagtacattatttccacaacttaaggagagactagaaggagagcttcgaccacttgtcccagatcactttgatgtgaagataacaactcaggaggaccccatactaggtgtatggagaggtggttcacttttggcttccagcccggatttcgagtccatgtgtgtcaccaaggctgagtacgaagaacttggatcagctcggtgtcgtagacgattctttcattgaggctaaccaaaacaatatcacatgagttggttgtaagttgaaattcttcacattatttgtcgtatattgtaatgcatgtattgtttttcttcttcctctaatttgataaacttcaaaccgtttaagtaataacca

SEQ ID NO: 406 - DNA, 1532 bp, Arabidopsis thaliana
aaaaaaaatcatttcctcagagttagaccaaagtccaaacaatggaattcagttgtgttcattttcttcaaaacaagacgattcttgtcacaggcgcaaccggtttccttgccaaagtttttgtggagaaaatattgagagtgcaaccaaatgtgaataagctgtacctcgtggtgagagcatccgacaatgaagccgcgacgaaacgcttacgcacagaggcattcgagaaagatcttttcaaggtgttaagagataatcttggcgatgagaaattgaatacattgttgtccgaaaaagttgtcccggtcgcaggtgatatcgcgatggatcatttaggcatgaaggactctaatctaagagaacgtatgcaaaaagaaatcgatattgttgtcaatgtcgcagctacaactaatttcgacgagagatatgatattggtcttggaataaacacatttggagctctcaatgtccttaacttcgccaaaaaatgtgttaaagctcaattgcttctccatgtttcaactgcttatgtttgcggagaaaaaccaggtctcctacctgaaaaaccgttcgtcatggaagagatttgtaatgagaatggtcttcaattggatataaaccttgaaagggagctgatgaaacaaagattgaaagaactcaatgaacaaggttgttcagaagaaggcactactttctacatgaaagaactcggcatggaaagggcaaagcttcatggatggccaaacacatatgttttcaccaaatcgatgggagagatgcttcttggtaaccataaagaaaatcttcctctcgtcattatccgtcccacgatgatcactagcactctttttgaaccatttcctggttggattgaaggactaagaactgtagacagtgtaattattgcgtacggaaagggagtgctcaagtgttttcttgtcgatgtaaactcggtttgcgatatgataccagcggatatggtggcaaacgcgatgatcgcagctgcagccacacatgctggaggttcaaaggttcacatggtgtaccaagttggttcatctcaccaaaacccaataatatatggagagatccgtgaaattttgttttgttacttcaccaaaaactcgttgcgcagtcgcaatggctcaatgataactgtctcgaaaatgaagctgataccaactctggctttgttcagcctctacatgaccatacgttacaaactacctgtccagttattaaaattggttgatataatatatccttcgagggaaggagacgaatacaaaaacaaaaaccgcaagatcgatatggtgatgagattggtaaagctttacgagccttacgtactcttcaagggcatattcgacgataggaatactaaaaacttatgcgccaagcagaaagaagaggacaacagaaattcagaaaattttatgtttgatttcgaccctaaaatcattaaatggaaagattatcttataaatgtacacattcctggcctcatcactcacgtgcttaagaagtaa

SEQ ID NO: 407 - DNA, 1985 bp, Arabidopsis thaliana
attttaaatagtctctttcgtttatgtatatcacaaatacatatcacaacgttcatatttgcaatgtgccaaaatcctccacgtgttaaatccatttgttcatagtttctcgttacaagacaacaaatggtatcaatgtccacggaaaaattgcatacttgcacgcaatctcttcttcttcttcttcgttcttctcgtagcttgaaataagattcatcagaagagtaaataaacatcaaaatccaacaaaccaaactagaaaaatgtcagtagttttactctcttctacttctgcaacaatcaccaaatcccaatccaaaaagattccctttttatctcccaccacaaaattcccattaaaggtctcaatttctccatcaagatcgaaacttttccacaaccctttacgcgtggcggcgccgccgtctgtacccacttcggattcgacggaggagaagcggatcgaagaagaatacggcggagataaggaagaagaagggtctgagtttaagtggagagatcattggtatccagtttctttggttgaggatttggatccgaatgtgccaaccccgttccagctcttgggtcgagaccttgtactctggtttgatcggaatgatcagaaatgggcagcctttgatgatctctgccctcaccggctcgctcctttatctgaaggaaggttggatgagaatggacacttgcaatgttcgtatcatggatggtcatttggtgggtgtggatcttgcactaggattcctcaggctgctacttcaggtcctgaagctcgtgctgttaaatccccgagagcttgtgctattaagttcccgacaatggtgtctcaaggtcttctctttgtgtggcctgatgaaaatggttgggatagagccaattcaattgaaccccctaggttgccggatgatttcgataaaccggaattttcgacggtgacaattcaaagggatcttttctatggatatgatactctcatggaaaatgtatctgatccttcccatatagattttgctcatcacaaggttacaggaagaagagacagagccaaaccattgccgttcaaggtggagtcaagtgggccttggggtttccaaggtgcgaatgatgacagtccaaggataaccgcaaaatttgttgctccgtgctattctatgaacaaaattgagttagatgcgaaactaccaatcgtcggtaatcaaaaatgggtcatttggatttgctcattcaatataccaatggctccaggaaagacccgttccatcgtttgcagcgcccgtaacttctttcagttctctgtaccaggaccagcttggtggcaggttgtaccaagatggtatgaacactggacttcgaacttagtctatgacggagacatgatcgtacttcaaggacaagagaaagtattcctcgctaaatcaatggagtcaccagactacgacgtgaacaaacagtacacaaagctcacattcactccaacccaggcagaccgttttgttctagcattcagaaactggctcagacggcatggtaagagtcagcctgaatggttcggctccaccccgtctaaccaacctctcccttccactgtcttaaccaagcgtcagatgctagatagatttgatcagcatacacaagtatgctcttcctgcaaaggagcttacaacagtttccaaatcctcaagaagtttctcgttggcgcgacggttttctgggccgccacggctggtgttccttctgatgttcagattcgactggttcttgctggtttatcactgatatcagctgcttctgcatatgctttacatgaacaagagaagaactttgtgtttagagattatgtacattctgaaatcgagtagatttgttgtgtatatgtataatcatcatacaaagtacaaacattgtaaatcaaaatccagaggaacttttagcactataaaaccgatttaaccgttaaattttgggta

SEQ ID NO: 408 - DNA, 1717 bp, Arabidopsis thaliana
caccaattcacactctcccaaatctctcttctttaacaacaaaaaaaaaaatcacagagacatagagagaagaagaaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgtgatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaacgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaccgacactcttctgactcttcttttgc

SEQ ID NO: 409 - DNA, 3496 bp, Arabidopsis thaliana
aaaagaaaaaaggaagaaaggataacacaaaacctctctctatctctctcgtcttccaaaaatcgagcactacacattgactctcttctacaaagagtctggtcacactcatggccatcctccatttctctcttcctcttatcgtctctttccttcgtcctcacgcctctcctcgcttcttcctcctccctcgctctctttctcagtcccctttcctctcccgccgccgttttcaccgtacctccgccgtttcctccgccgctgttcatcaccaatcctatcgtaatcccgacgatgatgttacccgcgcggtgtctgttcctacattccaacaagcgattcaacgcctccaggaatattgggcttccgttggatgtgccgttatgcaaccaagtaacactgaggtcggagctggcaccatgaatccttgtacctttttgagggttcttggtcctgaaccatggaatgttgcttatgttgagccaagcatacgtcctgacgactctcgctatggagagaatcccaataggcttcaaagacacactcaatttcaagtcatattgaaacctgaccctggaaactctcaacagctctttatcaacagtctttctgctctaggtattgatgtgactgcacacgatatacggtttgtagaagacaactgggagagcccggtgcttggtgcttgggggttgggctgggagatttggatggatggtatggaaatcacacaatttacttacttccagcaggctggaagtcttccgttgtctccagtatctgttgaaataacttatgggcttgagcgcatcatcatgttacttcaggaagttgaccatttcaaaaagatcttatatgctgatggaatcacctatggggagcttttcttggaaaatgagaaggaaatgagctcatattatttagagcatgctagtgtggatcgccttcaaaagcatttcgattattttgatgaagaagcacgttccttgcttgccttaggacttccaatccctgcgtatgaccagcttctgaagacatctcacgcttttaacattttagacgctagaggtttcattggcgtaactgaacgtgctcgttatttcggtcgaatgcgtagcttggctcgccaatgtgcccaactgtggttagcgacacgtgagtctcttggacatcctcttggtgttgcctccgaaccagttcctcccgtttgtcacagagctgctctggaaaaagtggctgaaaaggtttctgaagatccaagatcgtttattattgagatagggactgaagagatgccacctcaagatgttatcaatgctagtgaacaactcagggtcttagtgctagaattactagagaaccaaagattgcggcatggtgctgtgaaagcatttggcacacctcgcaggctagtggttttagttgatgctatgtcctcgaagcagctggaagaggaggttgaagttcgaggaccccctgcttctaaagcttttgatgatgaaggaaatcctacaaaggctgctgagggttttagccgcagatatggcgttccattggaaaaattgtacagaaaagtttctgggaagacagaatatgtacatgcacgagttacagagccagctcgacttgctttggaggttctgtcagaagatttacctggtatactggctaaaatatcgttcccaaagtcaatgcggtggaactcttcagtaatgtttagcaggccgattcgctgggttatggccttacatggtgatctggttgtgccattctcctttgctggcatctcaagtggaaatgtatcttgtggacttcgcaatactgcttcagcatcactgttggtacagaatgcagaatcctatgaagatactatgaggaattctggaatcaatattgagattgaggaaaggaagaaaatcattcttgagaagtcaaatgcactagcaaagagtgtgagtgggcgccttgttgttccgcagaacttacttaatgaagttgcaaatctcgtcgaagctcctgtgcccttaattggaaagttcaaggaatcattcttagaacttccagaggagctattaactattgttatgcagaagcaccagaagtatttttccattattgatgagagtggacagctattgccttactttattgctgttgccaatggtgcaataaatgaggatgtggtgaagaaaggaaatgaagcagttctcagggcacgttatgaagatgcaaagttcttctatgaggtggacacaaggaaaagattttctgaattccgagatcagctacagggaattcttttccatgaaaagctggggacgatgctggataagatgaaccgcctcaaaaagatggtatctaaactttgtttggccctcaaaattgatgaagatctgcttccggttgtagaggatgctgcctcacttgctatgtcagatcttgcaactgctgtagttacagaatttactgcgctgtcaggaataatggctcgtcattatgctctcagagatggctattcagagcagatagcagaagctttgctggaaattacacttcctagattttctggagacgtcatcccaaaaacagatgcaggaatggttttggcaataggtgatagattggatagccttgttggtttatttgctgctggttgccagccaagttcaacaaatgacccttttggccttagaagaatatcatatggcttagttcagattttggtcgagaaggataaaaatgtcaacttcaaacgtgttctagaacttgcagccagtgtacaaccgacgaaggttgaggcaaacactgtagaagatgtgtatcaatttgttactcgaagactggaacagctattggttgacaacggagtaagccctgaagtagttaggtctgtcctagcagagcgtggaaacaatccttgtctggcagcacggactgcatacaagacggaaaagctaagcaaaggtgagatgtttccgaagatagtggaagcatattctcgtcccacacgcattgtccgtgggaaagatgttggtgttggagttgaggtggatgagaatgcatttgagactccccaagagagaacgttgtggagtacttacacctctatcaaagatcgaattcacactggcattgaaatcgaggacttcaccgagatatccatgcaattggtggagccactcgaggatttcttcaacaatgtatttgtaatggtggaggaagaaagagtgaggaagaacagactcgctctgcttaataacattgccaatcttcccaaaggagtcattgacctctcatttttgcccggattttgatctttacttgtttcataatcccactccggaatcatcaattcattgacctctcattttttctttgtttcataacctcatatagttgtgttcactgagcaaaaattcaaactaaaacttgtgcaatggaatactttaaaaacagtttcataacctcaataaaaagatttcaaagatttttagat

SEQ ID NO: 410 - DNA, 11915 bp, Arabidopsis thaliana
caatatctgttgcgcttctacaggaaaatcactcacattgcgaggaaaaaagattatttgactcaaggaaacaaaagataattcggaaatttcttttgttttcctctcagtgatgaaattacaaaacccagataagaaaaccctaagagaaggctttagtcaggaatctagtgtagtggctttagattctggagttttagctatgagtggtttgaaatgcgatgggaaattcccggtcaaggatgtattaatggaagaaggtggtgataaagtgaggaagattcaagtttctgggggaaatatatcacttgttgttgattttagtggagctaggactagttctaacaatttctttgagtctaatgctagttgtgtcaatgagaatctggttaaaggaaatgggtacagagaagatgaaactcaggagtttcttgttggtaatcttgtgtgggtgatgactaaatacaagaagtggtggccaggagaagtggttgattttaaagctgatgcaaaggagagttttatggttaggtctattggtcagagccatcttgtttcgtggttcgcttcttcgaagttgaaacctttcaaggagagctttgagcaggtgttgaatcaaagaaacgataacgggtttttcgatgcgttacagaaagctatgtccttgttgagcaactcgttgaaacttgatatgacttgttcttgcattgctgatgggaatggaattgtgtcagcccaaaatataacaactcggaagaacaagcctttgatactgcgtgaattctcagtagatcggttggaaccaaaagagttcgtcactcagctgaagaatattgcgaaatgtgttttgaatgctggggtactcgagtcgacagttatgcagagtcagttatcagctttttatactctctttgggcataagcagataccaatggcccaactacacgaaaatgagggtaggaaaagtttcactgcgaagatgagtgacagtaagttcattggttctccatccatttgtgcaggtaatagcaggaagaggtttcggaaagaatggtttaggaaatttgtaagtgaggttgataatgtatctgcgagagacgatctagtaaatgtgcctccttctgatttgatatctaaactcaagctgcttgctgtgggctacaattgttcggaagagactgaaaatattgggctctttgagtggttcttctccaaattcagaatttctgtgtatcatgatgaaaatgcttacaagatgcagttggctaacatggctggtttcaaggatttgatgttagcaacaaatgcaaatcgtggtactgttcagaaaaccttaaagtcaaagaaaatagggaagtcaaagatggagcctctcaatggtgtttcagttgctgatactgagcagaagacctttgagttgcagatatcaaagaagtccaacatcgaatctcttaatggtgtttcagttgctgatactgagcagaagacctttgagttgcagatattagagaagtccaacatcgaatctcttaatggtgtttcaactccaaatattgaccacgaggcctccaagtcaaataattcagggaagacaaagatcaatcatatcattggtcactcaaattttcctagttctgttgcaaaggtgcagttggcgaaagattttcaagacaaactgttggtacaagctccagacaggaaagctatgacggcagatacactcagcagacctgctgctatacttgtaccggacctgaacagcggaggcaatgctttgggtactgcagagtttgaccatatgcaaagacctgagactttaattcagcataatgtctgcccacaagaggagaagacaccaagatctacgatacttaactttcaggtgacagctcatcagggagtctcaggaactcagtttgtttctagccagccaacttcatacaaacacttcacgagtgcagaccttttcacttattcagggaagaaaaagagaggaaggaagaggaagaatgcagaagagcttccaatagttgcacatgccagtgccactactgggatacctgacttaaatggaacaaatacagagccaactttggttctgcctcaagttgagcctactcagcgcagaagacgtcggaagaaagaggagtcacctaatggattaaccagaggaatcacaattctcttcttgaaattttcctcccaagtgtcaatgccttcaagggacgacctaacctcgacattctctgcgtttggcccgttggattcttcagaaacacacgtttcagaagaatttagtggtgcacaggtcgcctttgtgagtagtgcagacgcgatagaagcagttaaaagcttagagaaagctaacccatttggtgaaaccttagtgaatttccggttacagcagaaactgataaccgttcaaaggaacattgccccacgaatgccggtaatctcacatgttagtccagttccgaaaccgaacaatataccaacaagtatggatgcaatgaggcagaatctgttgatgatgacagcaatgctggagaaatccggggatagtttatcaagagagacaaaggcaaaactgaaaagcgagatcacggggcttctggaaaaggatggtgtcaagttattgaatacatggctcgaaggggaaaggtcaattaccttttgtagatttctttcgcaaaacactgctaagctaaagttggacgagattccaaatgctgaaacgtggccctttttggttaaacttctccttcaatgtgtctcaatggaggtgtcaggtagtaagcgacggatgcccaagccaacttttgcaaagacacttcgcgttgtcgttcagcgaacagaagaaactaaatttcctggtgtacaatttcctttgctatctatggctaaaaccctttttactcatgtacatgatatcttgagcaacacaccaagctttcagtcagagtatggtaccatactccgccatcttttggaaattaaggagtaccgttttcaaatgaggaagcgtacatattccagtttggtgctgctatacatggaaagggctgagacagggttttgcgagaaaaacagtggtcaacatagccagaaggaggaagcttttcgctatattcttacgcttcagtcacttctagagaactcccctggtgattttcctgatgaccttcgagaagaaattgtgaacggcctcattcacatcttctcttctgtaagagatgaggggaagctttcacgcaagcttattgaatgtgtaaatacgttcttgctgaaggatggtcctaatttaggctctttgtcattggaaattcataatgcggttgaacaatttgtgttccgttgctggttaacaacccatgataaaaacctcaaggagatacttgtttcttatggaaggctacagttaaatttgacaagggattctagtgaatctagttctctagtggaacaacttttggacgtggttactcgtgaattggatcttggtagttcatcaagttctgcatcatggggtgatacaacaaaggatgaaaagttaggggcactgagcagctatcagaatagcttggttgagctggctgcacatgtgttctaccgggcatgtgtcaatacatctagaccatcactgtcagagaaacgagctcgtaggcaacatattgcgatgcgtatggtggatgcactaactgaaggaaaatggctatggtgtgctgcttttggttgtttagttcggaattattgtgctcgcatcaatatggatctccttatttactggtttgaagccatctgcacaaactttcagagacttctggaggatgccagtatgagacgttcttatgatggtctactatggactttgaggagtttgcaagggctctcctctggtttgtcacttccagatattactatggacatatcgaagtcatctgcttcttcaagcgagctagatcgtggttggcaatcgatttggagttctttaatccacgggctagcaacattcagcagcatgagtgtaattgttgatgctgtcttggtactccttggatcaattatttcaagtaaccacattaccgttaaaattctgcctcaagaagtttgggatcatcaattattcagacacataccctctgagccggccttgtacttcattgcatgttacttttcacgtatgggttgccagggaaacctgcaagatgatttacatcttcgacgaaatcttcttagagcagtttgtgcccctctaagttggaaggttcgtttgactctagatgagagaatggtccagcttctaccagcagctgctttttccctatgtgctggtttcaaggtttcacttccattgcctaaggaacatcttccaacaccatctcaatgggatgtctgtgaacagatagatgatgttgatcgagaaagaaattttggactctttgaatgctctgtggaggctctaacaagaatttgctcaaattctagcaagatctctggctgccaagttcctgacgtagtacaactacctctggtgttaagagatccattgcttcatgacatggatatctattttcttagcattataccggaggtcaaggagaaaggaccattgtctgacatctttatgggatgtgctctgttgtgtcattttatgcatggttcttacatcacaaggaagggtaaaggaagcagttcgttcttcttaaaggcatgccagtatttgttagaaggcctggatcatgctgttgaatcagtttcaaagagcctcaatgatcttcaaaggcgtggttccttagggtttggctcagattttaatgagaaaggttctataatagtttcattgaggtcctttactcaatctcctgtcttcagcaacagaagagaccaaaatctccttggcgctagttatgattttgtaattcattccttagagaaccttttgcggtcttttgctaaagtctatgaagaatatactgagcacgcatggaatacacattcagacactgtaccttctaaatccttagcacctgattccccagaagttggcaggattgtggatatggatttagatttagctgaagacactaaagagagggatattatagctgctgggggaaaagctgtacctggcctgcccgtttctatgggtaactggaagttgggcatggtatcgcttatctcatgtttttctccggtacttcagtttcctacatgggatgttctatataatctattggagaaggaatctgatcctaaggtactggaaaatatactgtatcatctatgcaagctttcatgcttgacttctattccgaaggttgatgatttggttattttcttggatggcatgcttagcacacaagtaaagatgaagcgtaactgtctcaatatagtcactgctctgcatgttttacttcatactttatcatcctcgaggagggattcctctggagtcgaaaaaaattgtggtttgtctttgaaagaagcagaaagttttcaggtctttgtccaacttggcgcaatggtgaataaagtttctgaatttggtctcttgggatggtttgggcgtgtcaagctgatcaactgtatatgtgatcttgtcttacttaatcctcagactggtcagacaatgattgagcgacttctgttgatgctaagtgactctgattatcgagtgaggtttgtcttggcaagacaaattgggattttattccagacgtgggatggccatgaggcattattccaagatatttgctccagctttggtattaaattggtaacctcctcaaaggagaaactagttaccgcaaaagatgttttggctgttggtcctcagcctcgccaaaaaatggagactgtcatcattactcttatgcacctcgcttatcacagtgagaacatagagttgcaggctgtatttatgatgtgcgctgtttcagctaaagatccctgtcagagggaattaatcattgccgcacttgacaatttatcagcacaactccattacccatctaggttcaagtacctggaagaactcttgggcccaatcctttttcactggattgcatctggtgtcagtttagctggccttattgagacaagtcagcttttcattccaaacgctgaaccgaaatatttcatccacttttgttcccactggctgcttccagctcttctattgcatgaagatcatactaacctcgactgggtagctaagatggctggccaaccagtggttgttttggtcaaagaaaattttgtgccaatattttcgatatgtatgggattgcactgtagtaaaacgtcagaatgtgataaaggtgcaatggtgcttcagaattcaatattgtatgtaggtgagaccagcgagaatgagagggacaagctgattaaacagaatatggtgtctattgttagttttattttatcatgcgcttcgtcttcaccggaacctccagttcctactttttctcgtgacactatttcacttgcagttcaaacagttgtggatggttttctggaaaacactgattatcctaagaatgcggccatcactgacaggataaacatttttcgcccggatagagtgttcatgttcattacagaaatgcactatagaatgtcagctgcatgccatcatcggcatacgcgtcatcatttggccgctcttgaagagcttacaattcttcttggtcatagagcgttagttccaagttccttaaactacatattcaatcttgttggacaatttatcggctatccctcactacaagaccagtgttgtagtatagcgtcctgtttgctggatttgttcaaaagcaatcctgccaaagaaattgttagtgtactaggtgaccaactccaatttttggtttcaaagctggttacatgctgcattgatgctgaagcagataccaaaatttctggtgcgaagtcatctcaactggttaatttgctacacaagctagttgttagttcagactcttctcttaatgaagatatcagagacttggaaccactcccggatttaaaatatttccaagtcattcgtgaatcacacattaggatctgcgaagcatattctccgaggaatcatctgttgaaggttgaacactctacatttttaatttacatttttcttgaaattttatcactatccaactttttgtttctttcctgttccactatccaacagtgttctagaagatctaattatcttccaccgagattcctttccaggagtctccaagcactgcataacaagctcatagcttctgaagtttctcaagaagatacaaatggagaaactgcagaaacattttggcagtctgacgatgaaattgtaaatgctgtttggactcttgtccgagtgtctgcctctgatgaagccgatagtatgagacttttggtgtctgattttctttccaggattggtattagggacccccacactgttgttttccatcttcctgggaacttagtctccatgcatggtcttcaaggttttggccataatactggatcaaaagtcagatctttgactgagaacggcatatccgatgaaacccttatcacactgctaaattttctgaagaagtatcttttggatgactccgtaaagattattgatgtaacatcacaaacccttcggggaattctttcaaccgaaaggggccagcaagcattatcatcttttgattcatgtgagagagctttgattgaggtgcatggtaggggcgtgaaccttgacattgtggaaaagatcttattggatagccaaaagcagttcaaagccgagaaattttcactggagacgcccgaagtgtggtccacagataataaaaactttgatagatggatttgtcagcttgtgtactgtatgatcgctttatgtgaggatgtcccaataaggttatgccagaacatagcattgctgaaagctgaaatctctgagcttctattccctagtgttgttgttagtcttgcgggacggatagggatggatatcaatttacatgacttaattacgtcacaggtgaaagagcatatcttcactgattcaaacaagctaacaaaatcgaagcaagttatgttaaatactctgaatgaactgcggatgtgttatgtcctcgaaagatcgattttttctgggcaaacaaagagagaaaagaattcaagatcttgttccacagctgctaagattagagatgtggaaagtggatcaaatggaatggcagcgtccataactactaattgggagaaggtttattggctttccattgattatcttgttgttgccggatcagcagtagtttgtggtgcatatttgactgcttccatgtatgtggagtattggtgtgaggagaaatttggcaatctaagccttggagatcctgatttttcttatcatgataagttaccggatcatgttgagatacttgtgtctgcaataacaagaataaacgagcctgacagcttatatggggttatacattcaaataagttgtctgctcaaataatcacattcgagcatgagggaaactggactagggcactcgagtattatgacttgcaagcacgttcacagaaaatggtggtgccaagtagcctttctgaaaatctagaggtggaacaatttcagccaacaactagtgcacggcattcggtttttggtgaaggggaggtccagagacaaccgttcaaaggactcattaggtcgttgcagcagacaggctgtatgcatgtcctggatttgtattgccgaggcttaacttcccgagaaggatgctttcagtatgatcccgagttcatcgaattgcagtatgaggctgcatggcgagcaggaaaatgggatttttcattactttatccgcaaacacattgccaacctctgcaacatgcaaagaacaataattatcatgaaagtttgcactgttgtttgagagcattgcaagaaggggattacgatgggttttatggaaaactgaaggatactaagaaggagcttgtgttgtccatttcccgtgcaagcgaagaaagcactgaatttatatactcaacagtagtgaaacttcagattcttcatcatcttggactagtttgggatcttcgctggacgacatcttcgcatcaaagtgtgcatggctatctagtcaaacaaatggcatgcgtagaccccgtcattccaacaatggatcagttgtcttggctgaataaggattggaactctattattacgcaaactcagttgcacatgactttgttggagccatttatcgcatttaggcgagttcttctccaaatcttgggatgtgagaaatgtaccatgcaacatcttttgcagtctgcttcattacttcgcaagggaacaaggttttctcatgcagctgcgtctctgcatgagttcaagtttctttgtgcaagaagtaatggacaacaacccgttccagactggcttggaaagcttgaagaggcgaagctattacatgcccaagggcggcatgaagtttccattagtcttgcaaactacattttacataattatcaattaaaggaagaggcttcagatatatatcgtgtcattggaaagtggctagcagaaaccagatctagcaattctagaactattttagagaagtatctcaggcctgcagtttcgcttgctgaagaacagagttccaagatctgcaaaagattagtagatagacagagccaaacttggtttcatctggctcattatgcagatgctctatttaagagttatgaggaaagactctcctccagtgaatggcaagctgcactgcggctacgaaaacacaagacgaaagagttggaggtgcttattaaacggtttaagagttcaaagaaggcaacaatctgactattcactgaagatccaagatctgcagaagcaactaacaatggataaagaagaagcagaaaaactgcaggttgacagggataactttctgaaacttgcattggagggttataaacgttgtctggaaattggtgacaagtatgatgttcgagtggtatttcggcaagtatccatgtggttcagtcttgcctcccagaaaaatgttattgataacatgttgagcaccattaaagaggtccagtcctacaaatttataccccttgtttatcaaattgcttcaaggttgggcagttccaaagatgaatcaggatctaacagctttcagtctgcattggtttcgcttatcagaaaaatggccattgatcatccataccatacaatcttgcagcttctggctttggcaaacggtgaccgtatcaaggataaccaacgcagtagaaattcttttgtggttgatatggataaaaagcttgcagcagagcatctcctgcaggatgtatcacattatcatgggcctatgattagacaaatgaaacaactggtagatatctacatcaagcttgcagagcttgaaacaaggagagaggataccaatagaaaggtagcactaccaagagagattcgtagtgtgaaacaactggaacttgtacctgtggtgactgcaacaattcctgttgatcgtagctgccaatacaatgaagggtcattcccgtttttcagaggtttatcagattctgttacagtgatgaatggtataaatgctccaaaagtagttgaatgttttggttctgatggccaaaaatataagcaacttgcgaaatctggcaatgatgacctcagacaagatgctgttatggaacaattttttggcctcgtcaatacctttctacacaataaccgggacacttggaagagaagattagctgtgcgcacatacaaggttattccttttactccaagcgctggtgttcttgagtgggtcgatggcacaattccacttggagattatcttataggaagctcaaggagtgagggtgctcacggtcgttatggcattggaaactggaaataccccaaatgccgagaacatatgtcgagtgcgaaggacaagcgcaaagccttcgtggatgtctgcacaaacttcaggcctgtcatgcattactttttcctggaaaagtttctgcagcctgctgactggtttgtcaagaggcttgcttatacacgtagtgttgcagctagttcaatggaaagttgggtacatcgttggtcttggtgaccgacatgccatgaatattttaatcgatcaagctacagcagaagttgtccacatagatcttggagttgcttttgagcaaggattaatgctcaagactcctgaaagggttccgttcagactgacaagagacatcattgatggaatgggtatcacaggagtggaaggcgttttcaggagatgttgcgaagaaaccctgtctgtgatgcgaacaaataaagaggcactgcttacaattgtcgaagtttttatacatgatcctctgtacaaatgggccttgtcccccttaaaggctttgcaaagacagaaggaaactgaagattatgatggcatgaacttggaagggttacaagaggagttcgagggaaacaaggatgcaacacgtgccttgatgcgtgtcaagcaaaaacttgatggctacgagggtggtgagatgagaagcatacatggccaggcacagcaactaatacaagacgcaattgacacagatcgtttgtcccatatgttccctggctggggagcttggatgtaaccaaccttctatatgcttccaattttttgtctatgaatagagaaatctttatgtaaagttgaaaaatactcggctgccaaattttgtctagcttaggatgggaggagcaatctaaaaacggcttttgcgtggaacagaacaaatatgtgaagtaacaagctcaagcctataatatattactgcttttgtgcattttgcgtattggctcatgaagtaaaataatttcacta

SEQ ID NO: 411 - DNA, 3112 bp, Arabidopsis thaliana
atggcggaagggactaagcaagagagaacgcttgaaaacaatttgctccacaaggtcggagaagccgtctctgctatttctgatgcaaagcatgtcgaccaagtgatctccgctattcattccgtcgccgttcttctcttcccggtcgatccatcgttgttttccggaaattttgaaatgctccacattgttcgtggttcaggaacttttggcttacttatgattctctatttgggctccgcacaggtctgtagctctgtagttccttctgcagatgagagaaatgaatggttggagacgttctatcgaggtgttgcgtttccaacgtttgctcgagttttgttgcttgatgttgcttcggattggctgtcttgtttccctatttcagtgcagaaacatttgtatgataagttcttcttagatggatctgttattgaggttgttcaagtcttggttccatttctacatcatgtgggagatggtggcgttaatgctaattctgtccagactaatgtggaaagattgcttatattgtgtttgcttgaaaatgatggagtgctcaagataactaaagaaattggtaatatttatcaaggacataattctagcaatggaagtctcaagcctttattatccaggctatcacagatcttgacctccattcctgataaagcacgggcttcctgcactgaggccaattgcacagttatcgttttatcatttgtcggggaagttttttcccgcatctgtcgacgtggattatcagatttgctgttaagtgaagtaacacctcatgtcctagctcaagttaggaggttactaaactcaaagataggtgctattgaggtggatacatttcagttggaccctacaacccggatttggtcgaaaactatggaagcagtgacagatccgtatgctgttgagaaaatggctgaacaacttttacatcagctatatgctgagcatccaagtgatgttgaagctttctggactatttggactttgtttcatcgcaatgtaatacatcaggcatcagtgaggcaagcaaaatgttttctatggcagcttgattctttctttagatacccctttttcttctttcatttccatcctaatgctgtgaaacaatgcgttcttgagtgcccaccggttactaatacacttgctaaaggtgatgtcacacaaggacttcttgaaacaacgcagcgactagcctcagtttggtcaaaacgggagtttctgcagtccgtccaattggagcagcaagcttaccttcagttcctgtttcccgtaacagatatatcagatataactgcagctcttgggctttgcctggagaacatgtcaagagaagaactagatagaacaaaggatgtaatgcacagtattcttcaaggagttagctgtagactggagaacccaggagatctggtacggaaaatggctagctctatcgcctttatgttctctaaagtaattgacccgaagaatcctctgtaccttgatgattcaatcactgataatgcaattgactgggaatttggattgcaaacggcatcaatcacaaatacaatggaaaatggagatggtgaaaacaaaagatcagcctccttaactgaagtaaatgagtctagtcgcagaaacaagcaaaaggaaaatcgcaagagtaagaacatatctgcttttgtattggctgatcccaatgaaatagttgatttggctacgttaaactgtgatacggagagtgataaagatgatggcgatgatgacgcaagtgtcagctctgataattcaagtgtcacttctttggagccatatgatcttatggatgatgataaggatttagggaaacaatttacacatttggtggatgttgttggagctcttaggaaaaccgatgatgctgatggggtggagaaagctatatatgttgcagagaaacttgtgcgagcatcacctgatgaattgactcatatagctggtgaccttgctcgaactctggtacaggttcgctgctctgatatagcaatcgaaggtgaagaagattcagctgaagaaaagcggcaaagagctctaattgcgttgctcgtgacccgtccatttgaatcccttgaaactctaaacaatattttgtattcgcctaatgtagatgtaagtcagcgcataatgatacttgatgtcatggctgaagcagctagggagcttgctaattccaagaccctgaaacctaaacacgaagcacggggacctctgatatcaaatatatcagatcctcaaccctggtatttgcctagcaatgcgagtaccccatggaaaaaggtgtctgagacaggatcttttcatctgaactgggcaaatcgatttgagagagagctacagtcaaagcctggacagacaaagaaaggaaaatctcgaaggtggagcctcaaatcagcagacagagatcaaaacagtactgactggtctcagaatagatttccactatatgcagcagcatttatgcttccagccatgaaagagtttgacaagaaacgacatggtgttgacttacttggcagggactttgttgtccttgggaaacttgttcacatgctcggcgtctgtatgcaatgtgcatcaatgcatccagaagcatctgcattagctatctctcttctagatatgttacaacgaagggaagtatgcaatcacccagaggcctatgtccgaagagcggtcctttttgcagcctcttctgttttggtttctcttcacccgtcttacatagtgtcaaccttggttgaaggaaatcttgatctttccagagctcttgaatggatcagaacgtgggctcttcaaatagctgactcagacatcgaccgagactgttacacgatggctttgtcatgtctccaactccatgccgagatggctcttcaaacttcccgagctttagaatcaactggtggaagtagcagcagcagtagcattagaccgatgaacataagtctaccttcgggtatctctaaactgacatcaatcaaacttccttcttcaaatgttcatctctagaaacgccattcccattaattcgggtctagtcacttctgtatagtagcatttcttcact

SEQ ID NO: 412 - DNA, 1278 bp, Arabidopsis thaliana
tcgttgacttctcctcctttctgtagcaatcgaaagattcaaatctcttgaaagaaagaatcttgaccgtcacctacagatctgaagaatattctcaaggatagagagagaaatggcgacggacttcaagtctttaccagtcatcgacatctctcgtttactcctcaagtgtgatgatcccgacatggcagaggatgtcggtgtggccgaggttgtccagcaactggataaagcttgtcgggacgccggattcttctacgtgataggccatggaatatcagaggatgttattaacaaggttagagagatcactcgtgagttctttaagcttccttatgaagagaaacttaaaatcaaaatgactccagctgctggatacagaggatatcagagaattggagaaaatgtgaccaaaggaataccagatattcatgaagccattgattgttacagagagattaagcaggggaagtatggggatataggcaaagttatggaagggccaaaccagtggccagagaatcctcaggagtttaaagagttgatggaggagtatattaagctatgtacagatctttctagaaagattttgagaggaatctccttagctcttgctggatcaccttatgagttcgagggaaagatggctggtgatcctttttgggtgatgcgtcttattggttatccaggtgctgagttcacaaatggccaacctgaaaatgatattggatgtggagctcacactgactatggcttgttaactcttgtgaatcaagatgatgacaaaactgctcttcaggtgagaaacttgggcggtgagtggatatcagccattccaatccctggatcgtttgtttgcaacatcggtgacatgttaaagatactttcaaacggagtatacgaatccacacttcatagagtgatcaataactctcctcaataccgtgtttgtgtcgcattcttctatgagactaacttcgacgcggtggtggagccattggatatatgtaaacagaagtacccgggagggagaggaggatgccaagttttcaaaagagctgtgtatggagagcatctcgtaagtaaagtccagaccaactttgctatgtaatggaaggcagatctctctctccttctttgtacacaatacaccaacttatcttaaagtttgatttgtaataatagtaaggtacttctttacttctgtgttatcattggatatacatgtatttgcttcaaaaaacaaaatgaaaaaggtaatttagtttgttgataata

SEQ ID NO: 413 - DNA, 1420 bp, Arabidopsis thaliana
caaattcgttgtggttaccaaaacgacgacgtggtgaagcaaatggcgagagtcgcctttgccacatcatcgccgccgttaatctcatcagttcgtactctccgccgtcatttctcagttttcgccgccgcgaatccagaaatgtctcgtccctctcaccacagctctctcgaagttatcggcggaggaagtgatcgtttcttaccgtcgttaaaggactcactcgctaaaccgtacaatgcgtttcctctaatcggatttaaccgccacgtggagacaatctacgcatctttctttcgttctgttcctttcgttagactccgccgtgaatgtctccgaactaaagacaacggctctgttgctttggattgggtcgccggcgaagataggcactttcctcctgattcaccaatcctcattttgttgccaggtttaacaggaggaagtcaagattcgtatgttagacatatgttgttaagagctcaaagtaaaaaatggcgttgtgttgtgtttaatagccgtggttgtggagatagtcctgtgaccactcctcagttctactcggcttcgtttttaggagacattggtgaagtgattgatcatgttgttgataaattcccaaaagccaatttgtatgctgctggatggtctcttggaggcaacattcttgttaactatttgggtcaggaatctcataactgtcctctcactgctgctgtttctttgtgcaatccttttgatttggttatagcagatgaagatttccataagggttttaacaatgtttatgacaaggccttgtcgaaatctcttcgtagaatatttagcaaacattctcttctttttgaagacataggaggtgaatttaacattcctttggctgcaaatgctgagacggttagggatttcgatgatggcttaacccgagtctcgttcggtttcaaatcagtagatgagtactattccaagtcgagcagctccaaagctataaaacatgtccgcatacccttgctttgcattcaggcagcaaatgatcccattgctcctgagagaggtatccctcgcgatgacatcaaggcaaacccaaactgcgtgttgattgtgacaccaagaggagggcacttgggatgggtggcaggtgaagaagctcccaacggagctccttggaccgaccaagtggttatggagtttctgcaacatgtagagaatcgtgaaaccattaacggggagagatctttcgaggatgtccatgatcagattcaagtctaattctgtttgtccattcttcacttggagtggtatgtttcacttgtacactgttgttgcgcacaagaataataaacatgtaaagaatcatagtatataagacttcttgcatttcctcctaatatagatgatactatcttcaagttccttagtt

SEQ ID NO: 414 - DNA, 1418 bp, Arabidopsis thaliana
aattcaacacggattttcaacacagagctgacgttagcatttgtctctgaaatcccagatccgaaaacccaacaatggcgtcagagaacaacggatccagatccgattccgaatccatcaccgctcccaaagctgattccaccgtcgttgaaccgaggaagatagctctgatcaccggaatcaccggccaggacggatcatacctgacggagttccttctcggaaaaggctacgaagttcatggtctgatccgtcgatcatcgaatttcaacacccagcgaatcaaccatatctacatcgatccacacaatgtcaacaaagctctgatgaaactccactacgccgatctcaccgacgcttcctctctccgtcgttggatcgatgtgatcaaacctgacgaagtttataacctagctgctcaatctcacgtcgctgtctccttcgagatccctgattacacagccgatgtagtcgcaaccggtgctctccgtctccttgaagccgtcagatctcacaccatcgacagtggccgtaccgtcaagtattaccaagccggatcttcggagatgtttggatcaactcctcctccacaatcggagacgacgccgtttcaccccagatctccttacgcagcttccaaatgcgctgctcattggtacacagtgaattacagagaggcgtacggtctcttcgcttgtaacggaatcttgttcaatcacgagtcacctcgccgtggtgagaatttcgtgacgaggaagatcacaagagcattgggaaggatcaaggttggtttgcagacgaagctattccttgggaatttgcaagcgtcaagagattggggatttgcaggagattatgtggaagcaatgtggttgatgttgcagcaagagaagccagatgattacgttgtggcaacagaggaaggacacacagtggaagagtttcttgatgtgtcatttgggtatttgggactcaattggaaagattatgttgagattgaccagaggtactttaggcctgctgaagtagataaccttcaaggagatgcaagcaaggcaaaggaagtgttggggtggaaaccacaagtagggtttgagaagcttgtgaagatgatggttgatgaagatcttgagcttgctaagagggagaaagtgcttgttgatgctggatacatggatgctaagcagcaaccttgatttgatcaattatacaaagatggagtttcttacatttatctgcttttatagagttttaaatttcgtttttttttctttctctttttgttgctttggtggttgtttgttgtctttttatgttttagtttctttgttgctttttaagttatctaaattgtttccctccaatgagttgaggatgaaagcgcagtgaattttgaatgaaggagcaaaaagaatcat

SEQ ID NO: 415 - DNA, 1932 bp, Arabidopsis thaliana
ataaaaccagtacaattttactaaattatgatgttaaagtaagagactttgaagaagacgacttagcaaagaccaaaaccaagaaattacataggaacaagccaagaagatacatagataatttctttttgcttgtaatatatttacaacttcataaacatcatcgttctgcaactctctactcgatatccaatcatggacgattgtcgattcgagacgagtgagttgcaagcttcggtaatgatatcgactcctttatttaccgattcttggagttcatgcaacaccgcaaattgcaacgggagtataaagatccatgacatcgccgggattacatacgttgctataccggcggtatcgatgattcagttggggaatcttgtgggcttgccagtcaccggagatgttcttttccccggcttatcctccgatgaacctctacctatggtcgacgctgccatactcaaactctttcttcagttaaagatcaaggaaggattggaattggaattgttaggtaaaaagctggtggtgataaccggccattcaaccggcggcgcattggccgctttcaccgcactttggcttctatctcaatcttctccgccgtcattccgcgtcttttgtatcacctttggctctcctctgctcggaaaccaatctctctccacctcaatttcacgatcacgtttagcacacaacttctgccacgtggtctccatccacgacctcgttcctagaagcagcaatgaacaattctggccctttggaacttacttgttctgttccgacaaaggaggtgtctgtctagacaacgctggttctgttcgtctgatgtttaatatcctcaacaccacagcaactcaaaacaccgaggaacatcagaggtacggacactatgtgttcacactttcacacatgtttcttaaatctagaagctttcttggtgggagtatccccgacaatagctaccaagctggtgttgcgttagccgttgaagctctaggtttctctaacgatgacacaagtggcgttttagtcaaagaatgtatagaaacagctacaagaattgttcgggctcctattctgaggtcagctgagttagccaatgagcttgctagtgtcttgccagcaagactcgagattcaatggtacaaagatcgttgcgatgcatcagaagagcagctaggttactacgatttcttcaaacgatattcgttgaagagagactttaaagtgaacatgagtcgcataagactagctaagttttgggacacagtgattaaaatggtggagacgaatgagttaccttttgattttcatttaggaaagaaatggatttacgcatctcaattttatcaactcttagccgagccactcgacattgcgaatttctacaaaaacagagatataaagactggcgggcattacttggaggggaatagacctaaaaggtatgaggtgattgataaatggcagaaaggagttaaagtgcctgaggagtgtgtgagaagcagatacgcgagcacaacgcaagatacttgcttttgggctaagcttgagcaagcaaaagagtggttggatgaggcgagaaaagagagtagtgatccccagaggagatctttgttacgggaaaagattgttccattcgagagttatgcgaatacattggtgacgaagaaggaggtttctttggatgttaaagcgaagaactcgagttatagtgtgtgggaggcgaatctgaaagagttcaagtgcaaaatgggttatgaaaatgaaattgagatggttgttgatgagagtgacgcaatggagacttagtaggactaatagcaaatcgaatgtttgatatgctatataacaatctgtatcattgttgttcatcatgtttatgcaagactttctgatgaatgttactatatattctaaaac

SEQ ID NO: 416 - DNA, 3341 bp, Arabidopsis thaliana
gtcaaatatttctgcacggaagcttcgaaaagaggtcatcaatggagtcttcactcttttctccatcttcctcttcttactcttctctcttcactgcaaaacctacgcgtcttttatcaccaaaacccaaattcacattctccatcagatcctccattgagaaacccaaacccaaactcgagaccaattcatcgaaatcccaatcatgggtcagtcccgattggctcacaacactcactcgtaccctttcctcaggaaaaaacgacgagtcaggtataccaatcgcgaacgcgaagctcgacgatgtcgctgatctcctcggaggtgctctcttcttacctctctacaaatggatgaatgagtacggacccatttaccgtctcgctgctggtcctcgtaatttcgtaattgtgagcgacccagcgatagctaaacatgttttgaggaattatccaaagtacgctaaaggcttagtcgctgaagtctctgaatttctatttggttcgggtttcgctatcgctgaaggacctctttggacagcgaggcgtagagcggtggttccatcgcttcacaggaggtatttgtctgtgattgtggagagagtattctgcaaatgtgcagagaggcttgttgagaagttgcagccttatgcagaagacggaagtgctgtgaatatggaagcgaagttctctcagatgacacttgatgtcattgggttgtctctttttaactacaatttcgattctttgactactgatagtcctgtcattgaagctgtttacactgctcttaaagaagctgagcttcgttctactgatcttctgccatattggaagatcgatgcattgtgtaagatagtcccgagacaggtgaaagctgaaaaggctgtaactttgataagggaaactgttgaagaccttattgctaagtgtaaagaaattgtcgaaagagaaggcgaaagaatcaatgatgaggagtatgtaaatgatgctgacccaagtatcctgcgtttcttgcttgcaagcagagaagaggtatcaagtgtgcagttacgggatgatcttctctcaatgctcgtagcgggtcatgaaaccactggatctgtcctcacttggacactttatctcctaagtaagaactcatctgcattaaggaaagcacaagaagaagtagacagagtgttagaaggaagaaacccggctttcgaggatataaaggagttgaagtacatcactcgttgtataaacgagtcaatgcgtctctatcctcatcctcctgtcttgataagaagagctcaagttcctgacattcttcctgggaactataaggtcaataccggacaagacattatgatttcagtctataacatccatcgttcttccgaggtatgggaaaaagctgaggaatttctgcctgaacgattcgacatagatggcgcaatccctaacgaaacaaacactgatttcaaattcatcccattcagtggagggcctagaaaatgtgtaggcgatcagtttgcattgatggaggcaattgtggcactcgcggtgtttcttcagcggttaaacgttgagctggttcctgatcagaccattagcatgaccacaggagcaaccatacacaccaccaatggattgtatatgaaggtgagccaaaggtaaaaaccagaatttatgttttcatgataattgattggtgtgaatggacttgtttcatagtactcttgagaaataaccacaaaaaaatgaattatggaaaatagttgtaccatcggaaatgtgaattttgaacagtgagatgctagtaccattaaagtttggtaattgtgttatcatttcaaatcaaactttcatacagcttgtgtttgttctccatttttcagtaattacgaaaatcaaaattttatttttttttgaatttctaaataatagactaaggtctaaaaccatcccattccatatggaccacacgtaacattaaccttaaaaaccatataaaaccatataaaaccaatactagtgggttctatagcgatgtgtagtttcactttcacgtacgaggaagattaaaaaaaatggagaacgaaagctcagagagtagaaacagagctcgtcttgccattatggagcttgctaacatgattagcgttcccatgtctctcaatgccgccgtgcgactaggcattgccgacgccatttggaacggcggagccaattctcctctctctgccgccgagatcctccctcgcctccacctaccatctcacactaccattggtggcgaccccgagaatcttcagcgtatacttcggatgctcaccagctacggtgtcttctccgaacaccttgttggatccattgagaggaaatactctcttacggacgtcggaaaaactcttgtaaccgactccggcggcctctcttacgctgcctacgtcctccaacatcaccaggaggcgttgatgcgagcatggccactagttcacacggcagtggtggagccggagacagagccgtacgtgaaagcaaacggcgaggcggcatacgctcagtatgggaaaagtgaggagatgaatggtctaatgcaaaaggcaatgtctggcgtatctgtaccgttcatgaaagctatattagacggctacgatgggtttaaatcagtggatattttggttgacgtaggaggtagtgcaggggattgtctgcgtatgatccttcaacaatttcctaacgtccgtgaagggattaatttcgatttacctgaagttgttgccaaagcccccaatattcctggagtgactcacgtgggtggggatatgttccaatcagttcctagcgctgacgctatcttcatgaagtgggtgttaacgacatggacggatgaagaatgcaagcagataatgaagaattgctacaacgcgttaccagttggaggaaagctgattgcgtgtgagccggtcttgcctaaggaaaccgatgaaagtcaccggactcgtgccttgttagaaggtgacatctttgtcatgaccatctatagaaccaaaggtaagcatagaaccgaagaagagtttatagagcttggtctctccgcgggattccctacttttcgacctttctacattgattacttctacaccatcttagagtttcagaagtaatattcaagcatttttcttctcatatttctaaaagcttcaaaataatgaatcaaaagacctctttgttaattgagttgagatatctagtgaagacattaatattttcatcaagatgtaataatctaaagtctatattctaagtgcatccttaaaaggcattttccatatatataagtttcatctttcg

SEQ ID NO: 417 - DNA, 876 bp, Arabidopsis thaliana
ctccatattcctcaacaacatcaaaatgttgactcccaccatttctaaatccatctctttagtaaccattctattagttctacaagctttctctaacacaacaaaggctcaaaattgcggttgttcgtcagagctatgttgtagtcagtttggcttttgcggtaacacttcagactattgtggtgtaggttgccaacaaggaccttgttttgctcctccccctgcaaatggtgtctctgtggctgagattgtaacgcaagaattcttcaatggaatcatcagtcaagccgcgtctagttgcgccggcaatagattttacagtcggggagcttttcttgaggccttagactcatattctcgtttcggtagagttggatcgaccgacgactctaggcgtgagattgcagcgttctttgctcatgtcacacatgaaacaggacatttctgctacatagaagagatagacggagcctcaaaggattactgcgacgagaatgcaacacaatatccatgcaatcctaacaaaggctactacggccgcggaccgatccaactctcttggaatttcaactacgggccagccgggacagcaattggtttcgacggcctgaatgcaccggaaacagtagccacggatccagtcatatccttcaaaaccgccttgtggtactggaccaatagggttcagcctgttatctctcaaggttttggtgcaacaatccgtgccattaacggtgctttggagtgtgacggggccaacacagccaccgttcaagctagagttcgttactacacggattattgtcgtcaacttggcgttgatcctggaaacaacctcacttgctaacaaaaacatctatttctctgtatacatat

SEQ ID NO: 418 - DNA, 2278 bp, Arabidopsis thaliana
actaaaacaatttactctctctctctctctgcaatgtcacaacctctcaccaccagacccaccgttaccggaatatctataatccctttccgacaaccgccgcctctctgttctttcctcttcgtcatcgttcttttcgtcgccactttctacactctccatcatccagacgccgttactcctcctcttctattttctcgaaatgcctataatgcccttcgtctccgccgcctcttcctctcctctgcttctaacgccaccatctcctcttacctccgtgaattgacccgtcatcctcacctcgccggaactaaaccctctttagacacacttcactacgtctttaaccatttccaaagcctcggacttgagacccatgtcgccgaatacgaagctctcttatcttatcctacgcacatctccgtcacggcaagttttagcaacacgacgactcttgagtttgacttaaacgacgttcccggagactctccggtcgttaggccttaccacgcttattctccatctgggtcggcgcaaggtaacgtggttttcgtgaatcacggcgaggagagagactatcatgcgcttgagtctattggtgtgagcgttaaagggtgtgtggttttagcgaggaaaggtgaaaacttgggaagaggagcaattgtgaaaatagcagaagctaaaggtgcgctgggagtgctaatatacgccgagaatgacggtggtggatttggcgggattgagagaggtacggttatgagaggaatcggagatccggttagcccgggttggcccggagttgtcggaggagaaaaactgagcttggatgacgaattggtcactcggagatttcccaaaatcccatctttgcctttgtctcttcgtaatgctgagatcattttggcttctctgggcggtgctagagctccgttggagtggcggaattcgggtcgtgtcggaccgggtcaacgggttggccctggacggatggttattaacatgacgtttcagggggagatgaaaatgaagaaaattaacaatgttgtggttacaataagagggagtgaagaagcggataggtatgtgatacttgggaaccatagagatgcatggacatatggagctgttgatccaaacagtggaacttctgctttacttgacattagtcgacgatttgctcttttgcttaaatctggttggagaccacgtaggaccattctcctttgtagttgggatgcagaagaatttggaatgattggatcaactgaatggattgaagaaaatgttcttaacttaggtgcaagtgctgttgcttatcttaatgtagattgtgcagtccaaggctctggtttttttgctggtgcaactcctcaattagacggtcttcttgtcgatgtcttgaagctggtacaggatcctgatgcagtaggcttgacagtggaagagacatttaagtctcaaaataacattattcagaggctaagtagagtagattctgatttttccggttttcttcatcatgccgggataccgtctatagacatgtactatggagcagattatcctgtctatcacactgcatttgactcctatgattggatgatccacaacgcagatccattgtttcaccgtcatgttgctatggctggaatttggggacttttaggaattctcttggctgatgagccactcataccattcgattacatctcttatgcagaccaattgcaggcacatagagataaactgagcaagctcttagaagggaaagtctctgtaaatcccttaagcatggcgatacaagagttctctttggttgccaaagaagccgcagatgaagcaaagaagttaaagggaaaatcatatagcaaaaatgatgtagcagcagcggcgaagagaagagagctaaatgacaggttgatgcttgtagaaagagggtttttggatgcagaagggatcaaagggaaggaatggttcaagcatcttgtgtatggaccggcggctgagccagagagcaagctaggattcttcccgggaatagcagatgccattgcgatgaacgcatcagagggaataattgagcacgagatatggagagtcgcaagagcgattcagagagcaagcaaagctcttaaaggaggtttcacatgagaaaatctgaaagagttctcttttgtgtatatattgtgactatagattgtagaagaataacgtcttatgaactaattttcataaccatttatgaaacaaacactataatctaatcatattcaagact

SEQ ID NO: 419 - DNA, 975 bp, Arabidopsis thaliana
actgagaaagaagtgaatccataagagaagacaacaaaagatctatctctataccacatattacactttttctccaatggcttctctgaagctttcaccttcttctccaatctccatttctaaggttggtgtgattccttcctctaagaaaggactttcatttcttgtaaaagcagagcaccattcctcgtcttcttcttctcatcttcaagataaatgtcagagacgtctgattgtaacatttggtgttgttgctccttggatctcattgcttagtagagctccattatcatttgctgcagaaagcaaaaaaggattccttgctgtctctgacaataaagatgcttatgcgtttctctatccatttggttggcaggaagttgtgattgaaggtcaagataaggtatacaaagatgtgattgagcctttagaaagtgttagtgtgaatttggtcccaactagcaaacagactattaaagaatttggccctcccaagcagatagctgaaacactgataaagaaagttttggcacctccaaatcagaaaacaacccttattgatgcatcagagcatgatgtcgatgggaagacttattatcagtttgagttcactgttcaagctagaaactacactcgccatgctctgggtaccatcacggttttcaacggaaacttctacacactgacgacgggagcgaatgaaaggaggtgggagaagatgaaagataggcttcacactgtggtagattccttcaagatcactgtttgaaaatactgtaatcaagtttgctttggttgtctcttgttttgcccatttcttgtatttttgtccattcttcttctctctttcccttaacaatattcttttcctgtaagagagattcaataactcttgacttgcctccttacctctctctctgcttttaacctaacttcatcttgtttggtcaatttgatctctagtcatagttttgt

SEQ ID NO: 420 - DNA, 1181 bp, Arabidopsis thaliana
gttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttctcctcataacgattaagagagagacgagagagttcattttatatttataacgcgactgtgtattcatagtttaggttctaataatgataataacaaaactgttgtttc

SEQ ID NO: 421 - DNA, 994 bp, Arabidopsis thaliana
gacgtgactcttctctctcttcctctccatcaatggcgaccacaaactctctccaccaccaccaccactcctctccttcttacacacaccaccgcaacaatctccattgccaatctcacttcggaccaacttctctttccctcaaacaacccacttccgccgcaacattctcactaatctgctctgcttcttccacctcctcctccaccaccgccgtatctgccgtttcaaccacaaacgcctccgccacaactgccgaaaccgcgaccatattcgacgttctggagaaccatctcgtcaatcaaaacttcagacaagccgacgaggagacacggagattactcattcagatatccggagaagccgccgtgaaacgtggctacgttttcttctccgaggtgaaaacaatctcccccgaagatcttcaagctatcgacaatctatggattaaacacagtgatggtagattcggatacagcgtgcaacgcaaaatctggttaaaagtgaagaaagatttcacaagattcttcgttaaagttgagtggatgaagcttcttgacacagaggttgttcaatacaattacagagcgtttcctgacgaattcaagtgggagcttaacgatgaaacgcctttaggacacttaccgctcacaaacgccttgagaggaacgcagcttctgaaatgcgttttaagccatcctgcgtttgcgacagctgatgataacagtggagaaacagaagacgagcttaacagaggtgttgcggtggctaaggaacaggcaggagtaggagcagacaaaagagtgtttaaaacaaattacagcttctgatgtctttctccttcttttttttttttttttaatattgattttctgatattgtgaaagtataaacaaatctctgtaatcatatcattaattaaatcggatttctcttcaatgtcagttccattgtgattatggatgtatgaacaaagccagatcattagttaatg

SEQ ID NO: 422 - DNA, 1014 bp, Arabidopsis thaliana
cgccggagggagaagcaatggtgacgattctatcaactcctctctctccaagacttacatttctctgtgaaacaaaactgtcattatctcggagcaatcgctcggtatgttgttcattgagtgaagaaccaaaagaccaatgcttgagtcggagaagtcttgtttatgttttagttgcttcgccgtgtttgttgttaccagcgttgtcttcatctgcgaagactaaatcaaagagtccttatgatgagagacggttactagaacagaacaagaggatacagagagagaacaatgctcctgacgagtttcctaactttgttagagaaggttttgaggttaaggtattagcttctgataattacatcaaggctgattctggcctcatatatcgggatttcaatgttggtcaaggtgatttcccaaaagatggtcagcaggtgacttttcactacattggctacaatgagtctggaaggcgaatagatagtacttacatacaaggttctcctgctagaatccgcatgggaaccaatgcacttgttccaggatttgaaatgggaattcgtgacatgaagcccggtgggcgaagaaggattataatccctccagaattgggacctccggtgggaccttcgaccttcttcagctcgaagcaatttgaagttttcgacgtggagttgctcagtatccagaattgtgagaggaggactataataggtttctactcagatgtcacatgcagttaacttccaaatgatggtcatcactaagcttcaatgaacctgcattcttcaatcttcaatactctaaatctgcacggcagatgagaactacaaagaaacaaaaagaacaattattctttgcttaggcatttatcttgtgggtttcatgtagagatgcacaattacatagagagacagataaagatcatgtaaagtctcgacctttttcataatcgtagtttacttttgttgctttgttgatcacgttttaagcgtttggagctttttgata

SEQ ID NO: 423 - DNA, 1761 bp, Arabidopsis thaliana
ttcgtcttcgattttctctctcaacgcaaactcgtaagctgcttccattttcccttctagaccattgatttgttcttcgaaaaaaccgttctttcttttgcctctcactctagttccttctctcatttctacttctctagcttcactgacttgctgctaccactaaatcttggcatttgtggaaagttgggaatttagggtttttgggtgtgtgtgtgaaaacaatggaagcactagttgttgatgctggctctaagttcctgaaagcaggagcagcaattcctgaccagtctcctgcaatgataattccctctcaaatgaaacgaatggttgatgatgggtcttcttcagctgataaccccaccactgtctttgaggatgtcactcttgatcctattgaaaggggtttgattagagattgggatgctatggaagatctgttgcgttatgttgtctacactgggcttggatgggaagagggaaacgaaggcaatatactttttacagatccactttgtactcctaaggctattagggagcaattggtgcagttgatgtttgaaacattcaatgtctctggattttatgcatctgagcaagcagtgttgtccctttatgctgttggacgcatctccggttgcactgttgatattggtcatgggaagatagatattgccccagttcttgaaggtgcagtacaacacattgcctcgaaacggtttgagctaggtggaaccgagctaactaaattatttgcccaagagcttggaaaaaccaacccgtcgatgaatctcagcatgtctgatgttgaaaaactcaaggagcagtatgcaaactgtgccgaggacgaaattgcttacaaaaaaacccaaaactgtgaaatcgagcagcatactcttcctgatggacaggtgataagcatcgggcgagagagatactcggttggagaagctctgtttcagccatcaatactgggactggaggagcatggaatcgttgagcagcttgtccggattatctccacagtgtcatctgagaaccataggcagctcttggagaacactgtactttgtggtggtacaacctccatgacaggattcgaaagtagattccagaaagaagcaaacttgtgctcatctgccattaggccaacactggtgaaaccgccagaatatatgccggagaatttggggatgtattcggcttgggttggaggagccatactagctaaagtggtgtttccgcagaatcagcacgttactaaagcagattatgacgagactggaccatcagtggttcacaggaaatgtttctgaaaccatagactataaaacgatgttgttgttgtagctgaggattttttttttggttggctttggtttgaagatgtggaccagattatgtagtacatttcaaattatggcttccaaatatcgactaatatgtgttcaatgagcccttttctgaaaacattgacaaggtaactttgccaatgccaacacacacccattgtcagtggaactctaaatggttttgcagatatgtaaccagtgaaactcttggttttgatgcagagaatggccaagatcctctttttcattttgttttgagatctttagtacttgtacaatcaaataacacagtccctttttgttttgttggtgttgtttgctgaaattcgagaaggaaagggtcagtgttaatgtctaaacagaattcaattttttttattttgtaaattggttgcctctttaccttgtt

SEQ ID NO: 424 - DNA, 1107 bp, Arabidopsis thaliana
cttttatagattacacaacacacgttcgtttctttcttcttctaacacactctgagtcttgaaggtcaacaacgtcgagaataatggcatcatctctttgtgcttcttctgccatcgctgccatttcttctccaagtttcttgggtggtaagaaactgaggctgaagaagaagttgactgttccagctgtgtccaggccagatgcgtcggtgcgcgccgtcgcagctgatccagatagaccaatctggttcccgggaagcactcctccagagtggctagacggtagcctccctggtgacttcggatttgatcctcttggtctttcatcggacccggacagtctaaaatggaacgtacaagccgagatagtccactgccgatgggctatgctaggagccgccgggatattcatcccagagttcctaacgaagatcggaatcctcaacactccgtcatggtacacggcgggagagcaagagtatttcacggacaaaaccacactctttgtcgttgagctcattttgatcggatgggcagaaggacgtagatgggccgatatcatcaagcccggtagcgtcaacactgacccagtcttcccaaacaacaaactgacgggcacagacgttggttacccaggtgggttatggttcgacccgttgggttggggatccggtagcccggctaagctcaaggagttgaggaccaaggagatcaagaacggaaggttggctatgttggcagtgatgggtgcttggttccaacacatctacactggcactggtcctattgataacctttttgcacatcttgctgatcctggtcacgccacaatcttcgctgctttcacacccaagtgagacaacgaaaaagggttatggggaggtgaatgcgtttgtgtgtgatcatgtttgtacaaatatcattttgaacttaaaattattatgtactttatataaattgtggtcgaatgcaaattaaggttccccgtaacactcttttcctaactcaatgatcataagatgcttttacattgtcattcggagcataaaagagtccatcttaattgtttttcgttattgttgatatctaagcttatgttcttcttct

SEQ ID NO: 425 - DNA, 2904 bp, Arabidopsis thaliana
atggcggagacgaaggccaagagactacttaaagtggaaatcagattcagctttctcgtcccaattcgattcactaacaagaggtaccaacatcgattcaacttgcccatctccaaaaagatcttcggtgactccgaaatgttctgtgcaagctcgaagattgggttgctcggtataacaaggaagcagagttttaaggtattggttcgaatcccattttcactggattctgttggacacgtggagaaagtagaggttaatgaagacgagatcttgagtagaagaagaagatcaggtcttggggatttggaattacttgtcaaaatatatctcaactatcatgaacagcgtgaagcattgttttctggaaaagctgcatctgtacctcctgtgaaatatgaagaacagggtattgtggttgatgaagacgaggtcttgagtagaagaagatcaggtcttgatgatttggaatcagtgagttctaagcttgtatatgcgaagaaattagctgaacaaatggagaatggggaatatgtgacccataaggatacttctcttctcaagttcgtttcttcttcttcttcttcttcagaggaagagtttcgtttcgttagctcaatccaaaacgcaattcttcgtcttgacttaattccaaagttgccggcgattggaagagctgtgcttgtgtataggaagagtaatgaggttgagtgtacagagttggagaaggagatgatgaggagaaagatgaaagcttgggaggaaagggatatgtcggagaaaggtaccgtggaagttttgcacaaggagggcttggaaaagccattgatgtcatttgagaagcctaagtttgatcggaatgaacttatgagtagcatatctaaagttaagggttcagagaagaaactggaactcgtgaattcttctcatgttgagctggactttgatgataagatccatgaaatcaaagtaatggctaggcgagcacgggagatagaagctggcatagaacttaatgaaaaggagaagcgcgatgtgaacaaagaaacaggcgacagtgatgaagatataagcattcagtcacagaagagtcttccacatgacggtttgacacacagtgaaggtgatgatgataaagatgaacgcttgggaacttcgactgacagtgagaacactgaactttctgcttttgctgttccgatgttgaatggggctatggtagattcaggttttccgaatcatgaaatggcagcatctgacaaaaaaaaggtgagtaatgtggtaccactagttcctacagacggagtcatccaagcttctgatgtcactaaggatcagttaagtatgatgaagaatagcactggtcgaaagtcacgggtcatacggtctgtaaaagaggctaaagagttcctttcaagaagaagtggtgagaaagagcttactcaggaactttctcagatggcccaagacagtgatgaaatcttcccaaaacagagcgacgaagagcgtggtgtagctagaaaacacaaattggatgttgattctcaaccccaaaagaatgactaccaaaaactctcagaaactgggactgcagttaagggatcgagttcaaataaaagagaagagctcaaatcagccaaaagctcttctggtggtactgaacatatagagaaggaagaaccatcaggaaaggagaattggatagagaaaactaccatgaatttgagcctagaaactcaggagcctggtacgattgctgatattgcagaactttaccgtagtgaatataatgatgagcttgagtggatgaaggacgaaaagctaagagacattgtcttctgtgttcgagataatgagctggctgatggcgtcagtgtgtatgatccactagaaaagatcataccgagatggaaagggccttcgcttgataagaaccccgagtttctcaataactatcatgaacagcgtgaagcactgttttctggaaaagctgcatctgtatctcctgtgaaatatgaagaacagagctctcatcaggaattatcagagtctgcttcctctgagaacactctcaccccttcatcagaaattacctcaagccagccaaagattgttgtagaaggaagtgatggatctgttagacctggtaaaaaatcaggaaaggagtactggcagcacacgaagaagtggtcacgtgggttccttgagttgtacaatgcagagactgatccagaagtgaaagctgttatgagagacatgggaaaagacttagaccgatggattacagaagacgaaatcaaagacgcagctgatataatggaaaagctgccagagaggaacaagaagttcatggaaaagaaactcaacaaactcaagagagagatggagttgtttgttcgagcaggcacttatgcaagagatgctgactgtttgtttttaaccgaaaagagcttattgatgttatcagtgctgtttaaagtgtatggggctatggtagattctggttttccggagcatgaaatcgcagcatccgacaaagaaaaggtgagtaatttggtaccactagttcctacacacggaatcatccaatcttctgaagcagagtattgtggtatttgttcaaatcccattttcactgtctatctggattctgttggaaatgtggcgaaagtagaggttgatgaagacgaggtcttgagtagaagatcaggtcttgatgatttggaattagtgagttctaggctgcagaaggttttggaagatcagatttcaggatcagacaaacttgtacaattacaagccaaatttaagaatgcacttgaggaagcagttttagcagaaaatggggtcgagaataattgtagagatgctgaaatcagctgcccagattcctctgcgccttaa

SEQ ID NO: 426 - DNA, 1378 bp, Arabidopsis thaliana
agtgtctcttcatatttacataaatagatatctctctctctctctctctctaaaccacatcttcctctccaccgttctttctcttccttctctctctggacttcaacttctggagaagtacaagacatttataaagtactgctcatcacccaacactaaacacaattgtcaaaagggtgtggtggaaggagaatctacttctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtaaattttggattattcttatatctcatctcaatatttcaaatttataactctagctagggtttcacatgaattactagttaattaatgtgtgatattaattggcaggtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaactttcttattactattttatgatatttgataatcgatcaggagaccttttttttttttcttaaagaaattttcggaactactagaattttctcttggaattgaaaatatattgttttctcagttgccgtgttatatatttaatatcaaaagcatgcagtagctaagctagctaggctttaccatacgtt

SEQ ID NO: 427 - DNA, 408 bp, Arabidopsis thaliana
atggctggtgcagcagcatttgttgaagctgataatgcagaggaaataatggcaaggatcgaaaccaaatcgcagaagattgaaagcttactcaaacactacaaacatgtcgaagctcttaaaacggctcttgatggttcgccacctaaaactctcgacgaacgttgcaagtcagctaattggatagttgtgcacagagctatcatggcgataaaggatatcgaaggaatgttaaattctcttactgccgagtattacgacattctcatgaagtacttgtacagaggtctttcgactggtgacgaacccacatgcgaacagtgtttgatgattcacgagaaactaacagagagagctggtctcggttgcattctccgttgtctgagtgatactaccaataccgtttaa

SEQ ID NO: 428 - DNA, 3197 bp, Arabidopsis thaliana
aaccctaacccgaatcggctttttgacaatccgaaattaggtaaccatgttcattgaatttatcgtttcaacacattcgaatcactgagtcctacgtttcagtttaattccctgatgcacattttgaattcggtttgcgtattggtcttcgagttttccgtcggcggccatggacgcgttcaaggaggagatagaaatcgggagctcggtggagtctttaatggagctattggattcgcagaaggtgctttttcatagccagatcgatcagctccaagatgtcgtcgttgcgcaatgcaaacttaccggcgttaatccccttgcgcaagaaatggctgctggtgctttgtccattaaaattggaaagcggccaagagacttgttgaatcctaaggctgttaagtatctacaagcagttttcgcaattaaagatgctattagtaagagggaatctcgggagataagtgctttatttggcatcacagtcgcccaggttcgagaattttttgttactcaaaagacaagagtgaggaaacaggtgaggctttcaagggagaaagtagttatgtccaatacgcatgctttacaagatgatggtgttccggaaaataacaatgccacaaatcatgttgaacccgttcccttgaactctatacatccggaggcatgttctataagctggggtgaaggtgaaacagtggcacttattccacctgaagatattccacctgacatcagcgattcagacaaatactttgttgagaatatattttctctgctgcgtaaagaggaaacattttcaggccaggtgaaactaatggagtggatcatgcagatacaagatgcttctgtgctgatctggtttttatcaaaaggaggggttttgatacttacaacatggttaagtcaagctgctagtgaagagcaaacaagtgtcttacttcttatcctgaaggttctttgtcatttacctctccacaaagcatctcctgaaaatatgtctgccatattacaaagcgttaatggacttcgtttctataggatatcagacatatcaaacagggcaaaaggtttgttatcaaggtggaccaagttatttgcgaaaatccaagctatgaagaaacaaaatcgtaacagttcgcaaattgattcgcagagtcaattgcttctgaaacagagtattgctgaaatcatgggtgatagtagcaatcctgaagatattcttagtctctcaaatggaaagtcagagaatgtcaggaggattgaatcgtcacagggtccaaaactgttgcttacttctgcagatgattccaccaagaaacacatgcttggttcaaatccatcgtataacaaagaacgcaggaaagtacagatggtggaacaaccaggccaaaaagctgctggaaagagtccgcagacagtaagaataggaacttcaggtcgaagccgcccaatgtctgctgatgatattcagaaagcaaagatgcgtgccctttatatgcagagcaagaacagtaaaaaggatcctttaccaagtgccattggtgattcgaaaatcgttgctcctgagaagcccttggctcttcattcagccaaggattctccacctattcagaacaatgaagctaagactgaagacacacctgtactctcgactgttcagcccgtcaatggattttcaactattcagcccgtcaatggaccttcagctgttcagcccgtcaatggacctttggctgttcagcctgtcaatggaccttcggctcttcagcccgtcaatggaccttcggccgtaattgtcccggtacaagctgatgaaattaaaaaaccttcaacacctcctaaaagcatttctagtaaggtgggagttatgatgaaaatgagttcacaaactattctcaagaattgcaagagaaaacagattgattggcatgtaccaccaggaatggaacttgacgaactctggagagtagccgctggtggtaatagcaaggaggctgatgttcagagaaacagaaaccggcgagaaagagaaacaacatatcagtctcttcaaactataccgttgaaccctaaagaaccatgggatagggaaatggactatgatgacagtttgacccctgaaattccatctcaacagccaccagaagaaagtttaacggaaccacaggattcacttgatgaacgaagaattgctgctggtgctgccacaacctcttcatctctaagcagtcctgaacctgatctcgagttattagctgcgttacttaagaacccagatcttgtttatgcactaacttcgggaaaacccagtaatttagccggccaagatatggtaaaactgcttgatgtgattaagactggtgcaccaaactcaagcagtagctcaaataaacaggttgaagaaagggtcgaagtttcccttccatctcccactccatcaactaatcctggaatgagtggatggggacaagaagggattcggaatccattttcaaggcaaaaccaagttggtactgcagttgctagatcgggtacacagcttcgtgttggttcaatgcaatggcatcaaacaaatgaacaatcaatcccacgacatgctccatcagcatacagtaactcgatcacattggctcacacagaaagagaacagcaacaatatatgcaaccaaaacttcatcacaatttacattttcaacaacaacaacaacaaccaatctcaacaacctcgtatgcagttagggaaccagtaggacaaatgggaacaggtacatcgagttcatggaggagtcagcagagtcagaacagttactactcacatcaagaaaacgagattgcatcggcttcacaagttacttcataccaagggaatagccagtacatgagtagcaatccaggatatgaatcatggagtcctgataatagcccaagtaggaaccagcttaacatgaggggacaacaacaacaagcatcaaggaaacatgattcttctactcatccatattggaaccaaaacaaaagatggcgttaaaccatatataagactatggttctttggtcctcaatatttgcttgtcatggttgaattagcattatactctgttcagacacagattttcatttttaactcacaacagattcatcagagataataaactaaaagaaagaatgaatggataaagttattactgtctcaa

SEQ ID NO: 429 - DNA, 835 bp, Arabidopsis thaliana
atctcttttctcttctcatcaaaacataccaataagcaatttgctcattagagaacagagaaaaaaaaaacaatggcaactcaagccgccgggatcttcaactccgccataacaaccgccgcaacctccggcgtcaagaaactccactttttctcaacaacccaccgtcccaaatccctctccttcaccaaaaccgcaatccgcgccgagaaaacagattcctccgccgccgctgctgcagcccccgccacgaaagaagctcccgtgggattcacgccaccgcagctagacccaaacacaccgtctccgatcttcgctggaagcaccggtggtcttctacgtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagtgtttcctaacggtgaggttcaatatcttcatcctaaagatggtgtttatccagagaaggcgaatccaggaagagaaggtgttggtctcaacatgagatctattgggaaaaatgttagtcccattgaagttaagtttactggcaaacaaagttatgatttgtaagatctgtaaactaaaaaaaccaaaaactatgtgcatgtggtgatgattatgactatgtttcatgttaatttttaatggattttgttttgataatttgttgttccatttggtttaatggatcttttatgggcctaaa

SEQ ID NO: 430 - DNA, 909 bp, Arabidopsis thaliana
atggagtttcatcttgaacatcctctctcacattcttcactccacaataacttcaacgacgacacagactatgaaactttaccacactctctcttcctcgtcgagtttcaacacatgccttcttctcattacttccatagcctcaagtcctctgcttttcttctctctaatcgaaaccaagccatttcttcaatcactcagtattcaagaaaattcgacgacccatctctgacgtatcttgctgtgaattatctagacaggttcttgtctagcgaagatatgccgcagtcaaagccctggattcttaagctcatatctctctcttgtgtctctttgtctgcaaaaatgaggaaaccagacatgtctgtttctgatcttccggtggaaggtgagttttttgatgctcagatgatagagagaatggagaatgtgattctaggagctcttaaatggaggatgcgctctgttactcctttctcctttttggcctttttcattagtctctttgagctcaaagaagaagatcctttactactaaaacattccctcaaatctcaaaccagtgatcttactttcagtcttcaacatgatatcagtttcctcgagtttaaaccatcggtgattgcaggcgcggcacttctctttgcttctttcgagctctgtcctctacagtttccatgtttcagtaacagaatcaaccaatgcacatatgtaaataaggatgagttaatggagtgttacaaagcaatacaagagagagatattatagttggagaaaacgaaggaagcactgaaacagcagtaaatgtgcttgatcagcaattctcgagttgtgaaagcgataagagcatcacaatcacagcttcttcttcacctaagaggaggaaaactagtactcgtcgttactaa

SEQ ID NO: 431 - DNA, 1064 bp, Arabidopsis thaliana
gccttatctgcttctctctctccagtggtctcaaatctctctgtgtgatcccacttgtcatcctcctccacaacataaagcttgagaccataaccctttagcgttttcggctaaagctttcgctgactactacaacaatggcgtcctcatccctttcccctgctactcaggttcactcttgatcgttcgaatcgaaacaatcgggtctcttcgtataggaatttgggtttttgaaagtttggtttttttttttggtggcagcttggttctagcagaagtgctttgatggcgatgtcaagtgggttgtttgtgaagccaacgaagatgaatcatcaaatggttagaaaagagaagattggattgagaatttcttgtcaagcgtcgagtattccagcagacagagttccagatatggaaaagaggaagactttgaatcttcttcttcttggggctctttctctacctactggctacatgcttgtcccttacgctaccttctttgttcctcctggaaccggaggtggaggtggtggtactccagccaaggatgcccttggaaacgatgtagttgcagcggaatggcttaagactcatggtcccggtgaccgaaccttgacccaaggattaaagggagatccgacttacctagttgtagagaacgacaagactctagcgacatacggtatcaacgcagtgtgcactcatcttggatgtgttgtgccatggaacaaagctgagaacaagtttctatgtccttgccatggatcccaatacaacgcccaaggaagagtcgttagaggtccagccccattgtcgctagcgttggctcacgcggatatagatgaagctgggaaggttctttttgttccatgggtggaaactgacttcaggactggtgatgctccatggtggtcttaagactcttcaacaagaaaaagagaaagatttggtctttttgtgtaagacttgtttgaatgttcttataatgtataagctacatttcatcgcaattactctgtgaattcttgcctcttatatgaaatattatgttcattcacttccca

SEQ ID NO: 432 - DNA, 3078 bp, Arabidopsis thaliana
atccactgaaacattcgtctccggcgaaacaaaaccagaatgagctctcatcatcaaatcctccaaattcgttctgacccatttgttctatcacactgttgccgccacacacgcctcaccagctctcttacgcttcaatctcctctaaagcagcccttttcatgtctccctttccgttggcgccgctcttatcgcggcggagtcaggagctcaacgacggagactcatggtagcaaaaaagaagctttggtgtcggaaacggcgactacatcgattgaattgaaaagggtctatccatttcacgaaattgaacccaagtggcaacgttattgggaagataaccgaattttccggacaccagacgatgttgatacttcgaaacctaagttctacgtcctcgacatgtttccatatccaagtggagcaggattacatgtgggacatccattgggttatacagcaactgatattctagcgaggcttaggcgtatgcaaggttacaatgtgttgcatcctatgggttgggatgcttttggattgcctgctgaacaatatgctattgagacaggaacccatccgaaaactacgacattgaagaacattgaccgctttcgattgcagctcaaatcattgggcttctcatacgattgggaccgtgaactttctacaacagagccagactactacaaatggacacaatggatctttcttcagctttataagaaaggtttggcatatcaggctgaagtaccggtcaattggtgcccggctcttggtactgttttggccaatgaagaagtggtggatggtgttagtgagcgtggtggccacccggttataagaaagccgatgaggcaatggatgctgaagattactgcgtacgctgatcgtcttctagaagatttggacgagcttgagtggcctgaaagtataaaggaaatgcaaagaaactggataggaagatccgaaggagctgagttgaacttttcaattcttgatggggaaggccgagaaactgacaaagagattacagtgtacaccacgaggccagatacactttttggagcaacttacatggttgtggcaccagagcatcagttgttgtcttactttgtaaccgcagaacagaaacagcaagttgaggaatacaaagatttcgcttcgaggaaaagtgatcttgagagaacagaacttcagaaggacaagacgggcgtatttacgggatgttatgcgaaaaatccagctaatggagatgctattcccatatgggtagctgattatgttctagctagttatggaaccggagcaatcatggcggtcccagctcatgatactcgggataatgagtttgcgttgaagtataacattcccatcaagtgggtagtgagaaatgaggcaaattcaagtgatgatgctaagcaggtttatcccggattgggcattattgaaaattcttcaactttagaaacaggacttgacataaatcaactatctagcaaagaagctgctttaaaagttattgaatgggctgagagaactggcaatggaaagaaaaaggtaaattacaagttgagggattggctatttgcacggcagcgttactggggtgaacctatcccgattttaattttggatgagtctggtgaaactattgctatttcagaatctgaactgcccctcactttgcctgagttaaatgattttacgcccactggaacaggggaaccaccactgtcaaaagcagtttcatgggtgaacactgtagatccttcaacaggaaaacctgccaaaagagaaacaagcactatgccacaatgggctgggtcttgctggtactatctgagattcatggacccgaaaaaccctgaagcattagttgacaaggaaaaagaaaaatactggagcccagtagatgtatatgttggtggtgctgagcatgctgttttacatttactatactcgaggttttggcacaaggtactttatgacattggtgttgtgtctacgaaagaaccattcaaatgtgtcataaatcaaggaatcatccttggggaagtccaatatacagcttggaaagatcaagaaggaaattatgtatctgcagatactgaagaacggttaaatgaacatcaacaagtgacaatcccggaagaaaaagttatcaagtccggagatcattttgttctgaaggaggatcctagcattcgtctgattccacgcgtttataaaatgagcaaaagtagaggaaatgtcgtaaatcctgatgatgttgtattagagtatggtgcagattctctacgtttgtatgagatgttcatgggaccatttagggactcaaaaacttggaacacgagtgggattgaaggtgtgcatcgtttcttggcaagaacttggagactagtcattggtttgcctcagtctgatggttctttcaaagatggaaccttagtaactgatgacgaaccaacccttgaacaactccgaactcttcataaatgcattgcaaaggtgacagaggaaatcgagagtacacgattcaacacgggaatttcagggatgatggagtttgttaatgcggcatataagtggaataatcaacctagaggaatcattgagccttttgttcttttgctctcaccttacgcgcctcacatggctgaagagctttggtcgcggttaggccatccaaattctctggcctatgaaagcttccctaaggcaaacccggattacttaaagaacacaactattgttcttccagttcagataaacggcaagacaagaggcaccatagaggttgaagaaggatgctctgaagatgatgcttttgttctagcttcacaggacgacaaactcaggaaatatctagatggacaatcaatcaagaagcgaatctatgtgcctgggaagatcctcaacgttatcctagaccggactaatgtcaaggtcactacaaagtaggatttagaaagaagaaacaattacaaaacctgtcaaatgaacaaaattttatctctattgagagtttccattatatagaaaaagattcttttagaagcaaaagatctgttcttagat

SEQ ID NO: 433 - DNA, 1020 bp, Arabidopsis thaliana
gtccgatcaagtcatacttcttcttcctcgattcgtcttcaccatcacattctctctaaatttggccatctcttgatcttttcttgtttaattgtatggtaaattatatgtttgcttagtgagaactttatacggaaatgcttagaggcttctccatcaaatgaaagaagaccttcactcatagttgtttccacgagagttcctcatattaaaaccaacaagcgagagtctctgtaataatcttcagataaggaatacttcttgtattgagcttcttacaaatataaaactttcattaacgttttggagttggcttctgatcttctccatcaacattcaacaatggcaatgaagatgaagggaatatacaaaagcttcaaatccataatgtttgttgggaaagaaagagatttggaaattgggcacccaacagaagtaaaacatgtggcccatattggttggggctcctctggcagtgatcctggttggatgagtgactttaaggcaggagcagagtttttatctccaagaacatcatctttcagtcatacaagacattcagattctttcttcaccacttctgattccactgaattcgatcaggaccaactgaatatatcagataggataagagatgtgcctcctataccagtaggtctatccaagattcatactaagagcaagaataggagaaagaaaccatcttcgacgtcatcaccaagatccagaccatctccaaaatcttcgagatcaatgggtttatcgaagtcatcacataaatcaatggtgtctcggttaaactctaatgcataattagagtgaactaaaaagtacaatgaatatacgaaaatcaaaagcttgttcattgtgcaaaagatttttttttttttttttgtagttctcgtgattttctttttttctaagtgtttgattcgtagttctttttttccgtagttctcatatatcgaaaagttctatgtacattgtagaaagacgtaaaaaaataaattattttttgtg

SEQ ID NO: 434 - DNA, 1842 bp, Arabidopsis thaliana
cactcacatcgtctcctccattttcaccactaaaaccagaccaaaaaccttcctttattcgtgcccttctgggccaacaaatgttcacaagcggtaacgtcaccgctcgggtcttcgaacgtcagattcgaactcctcctcccggcgcttccgtaaatcgtgcaagacacttctacgaaaacctagtcccaagctacacactctacgatgtcgaatctcccgatcactgtttccgcaaattcacagaagacggactcttcctcattagtttcagccgtaaccatcaagaactcatagtctatcgtccttcttggctcacttactccacaaccgatgattccacaaccaccctacctcctctacctcgccgtgcttcgaaattcgacagctttttcactcaactctactcagtcaatctcgcttcttctaacgaactcatctgcaaagacttcttcctctatcaccaaactcgtcgtttcggtcttttcgctacttcaacagctcagatccatgattcatcatctccttctaatgacgctgttcctggtgttccttccattgataagattactttcgtacttcttcgattagatgatggtgttgttcttgatgagagggtttttcttcatgatttcgttaatctggctcataatatgggtgtgtttctttatgatgatcttttagcgattttgtcgttgcgttatcagaggattcatcttcttcagattagagattctggtcatcttgttgatgctcgtgctattggttacttttgtcgtgaagatgatgagcttttcctcaattctagctctcaggcaatgatgagtcaagataagagtaaacagcagagtttatctgggagtaaggaagatgatactggagagaatgggttgcgtcatagtctaagtcagccaagtggttcgaattcgtttcttagtggtgttaagcaacggttactttcttttatcttcagggagatttggaatgaagaatcagataacgtaatgagagttcaaagtcttaagaagaagttttatttccatttccaggattatgtcgacttgattatatggaaggttcagtttttggatcgacaacacctgctaatcaaatttggaagtgtagacggtggggtaacaagaagtgctgatcatcatccagctttcttcgcggtgtataatatggagactactgacattgtagcattctatcagaactcagcagaagatctttaccaattatttgagcagttcagtgatcactttacagtatcaagtagtacaccgttcatgaactttgtaacatcgcattctaacaacgtctatgcccttgaacaactaaaatacacgaagaacaaatcaaacagtttttctcagtttgtgaagaagatgttactctctttgcctttcagttgtcagtcacaaagtccctccccatatttcgaccagtctctcttccggttcgatgaaaagttaatatccgcagcagataggcataggcaatcctcagacaacccaatcaagttcatatctcgaaggcaaccgcaaaccctgaaattcaagataaaaccaggaccagagtgtggaactgcagatggtcgaagcaagaagatatgttcattcttgttccatcctcatttaccacttgccatctctattcaacaaacacttttcatgccaccttctgtcgtcaatatccattttaggcgatgactctttttggtttctatcagtctagtagtcttcctacatgttgtaatctattgtttgtaacaaaagttcagtaaaacctctataaattccgagttgggccgatgtaaaaattaacaaacttcgataaaat

SEQ ID NO: 435 - DNA, 1057 bp, Arabidopsis thaliana
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatagatgtttatatgtctttcttatgagtctacga

SEQ ID NO: 436 - DNA, 691 bp, Arabidopsis thaliana
accaatctcaaagcaaattaaatacactactacttcttgagcttttaaactacacaaacaaatggctccaagaaccccccttgcactcttcgtttctctcaacctcctcttcttcacttacacctctgcaaccacagggacttgtcctaaaaattccatagagatcggtacttgtgtcactgtgctcaatctagtggacctaacattgggaaacccacctgtaaagccatgttgctcgctcatccaaggcttggctgaccttgaggccgcggtctgcctttgcactgcagtcaaggctagcattcttggaattgtcaatattaaccttcctatcaatctcagcgtactcctcaatgtttgtagtaggaatgctccaaagagtttccagtgcgcgtaagttgaatacctatgacatacctatgaaacaaacgaatcataccgatgcttgaacatgttttcttacctacttgttgttgttctaagatgtttgttttttctttctttcttggattgttaataatgaacgtacgacgttctgatgcaaaataatggaaaatggggttgtgtgtacaatcgacaagtttgtatatactcctttactttgttgttcctttgttttgttgttcctcttctttgtaactgtgtatttcaaatttgcttaataaaaatataaattgatgttgtagcttat

SEQ ID NO: 437 - DNA, 1488 bp, Arabidopsis thaliana
acaattctttgcatcatcatcattcatcatggattcttcttaccttagaatctctctttcttttctcttctgggctttactactctcaccggctgtgtcacagtcatcttcttgttcgtcacagacattttccggcgtcaaatcttaccctcactgtctcgacctccctgatcttaaagccattctccattactcttatgacgcatctaacacaactctcgccgttgttttctctgctccaccgtcaaaacctggtggttggatcgcttgggctattaaccctaaatccaccggcatggctggatctcaagccctcgttgcctctaaggaccctagcaccggcgttgcttccgtgacgacccttaacatcgtctcttacagctctctggttccctcgaaactgtcctttgacgtgtgggatgttaaggcggaggaggcggctaatgacggtggagctttacgaatctttgcgaaagtgaaggttccggcggatttagcggcgagtgggaaggttaaccaggtttggcaggttggtccgggagtgtctaatgggaggatacaggctcatgatttcagcggtcccaatcttaactcagtgggatcactcgatttaaccgggaccacccccggagtccctgtctccggaggtggtggtgccggtaattctagaatccacaagagaaatatccatggaatattgaacgcagtgagttggggacttctatttcccattggagcaatgatagctaggtatatgagaatctttgaatcagcagatcctgcttggttttacctccacgtgtcatgccaattctctgcttatgtcatcggtgttgccggatgggccaccggactcaagcttggttcagaatctaaaggtattcagtacaacactcaccggaacatcggcatctgtctcttctctatagccactcttcagatgtttgcgatgctgttgcggccaaggaaggaccacaagtttagattcgtttggaatatttaccaccacggagttggatactctatcctcatccttggaatcatcaatgttttcaaaggtcttagcatcttgaatccaaagcatacttacaagacggcttatatcgctgtgattgggaccttaggaggcatcacgttactcttggaagttgttacttgggtcattgtcctcaagagaaaatctgccaagtctacaaagcctctcaaggcctaatggtgttggtaattcaaaggatttgtattgttttattttcttttttttttgaagttagaaattgcattgtctttctccacaaattatgattcatctcttgacgttgcttgttttgaggatgatgattatgacttgtgtgttttatgtatagtaggagaaacacatatatgtcttagtgtttgttctttgtagctctgccttttatttcgtgtgtttttgtggttcagaatacttgtagggaattataaactaatttttcaatctttttttgtcgt

SEQ ID NO: 438 - DNA, 605 bp, Arabidopsis thaliana
atcaatcaaagctaaaagaacttattctctcacaaacttcaaatcctcatcatcctttttgaatcatcaatcatgtcgcaacaacaattcaacgccggacagaacagaggccaagctcaagagaaagctgagcaatggaccgagtctgcgaagcaaaccgcacagtccgcatgtgacaaaactgctgatttgacacaatcagcacgtgacaaggctgcagatttgacacaatcagctcgtgacaaaaccgctgatggatctcattccgctaacaaatctgcacaacataaccaggaacaagccgctggtttattcggccagaccggtgaatcagtgaagaacatggctcagggtgctcttgacggtgtgaagaacagtcttggcatgaacgagaagaaatgagaatttatacttctcaactattttatttaaaatatttatgaataatttcttgttttggaagttttgggtttctccaaattatgtttgtaataagattatttgttttgaaaggttttgtgatcatgtaatccgaaatctgagatgtaataagatgttgtaacatcacagcctttgtctattttaaaggaatgaaccaaattagc

SEQ ID NO: 439 - DNA, 3080 bp, Arabidopsis thaliana
atgaaaaaaataaaaataaaaacataatccaagatccctaaaaattcccaaaaagaaccctagattttctcctctcacgctccttggttcctcactcgcttttgcttccccactcgcctgcttcgtgttcttctttgctttgctcttttcacgtcagaattttgccttccctccctttgtctctctctgggtggccgagaaaatacagtgctaaggtggattatctagtagaaagatttcagtttccaatttcatggaagcccatagtggggtagttgcttttgagtgtgttagtgaatccatatgtggctaaggttaggatggatttgcaagagaatctggttagtgatgcaggggatgaccatatggttgacattgtagttgaaccgcatagtaacagagatataggaattgttgatgagttcaatataggtggagatgttggatttagtggtgatctggatcttgagccacgaaatggtatagactttgatacccatgaggcagcgtatatcttttatcaggaatatgcaaaatctatgggtttttactacgtcgattaaaaacagtagacgttccaagaaaactaaagacttcattgatgctaagtttgcttgttccagatatggtgtgactcctgagtctgagagtagtggtagtagtagtcgaaggtcaactgtgaaaaaaacagattgcaaggctagtatgcatgtgaagagaagaccagatgggaaatggatcattcatgagtttgtaaaggatcacaatcacgaacttttacctgcccttgcttatcatttccggattcagaggaatgtcaagttagctgagaagaataatatcgacattctgcatgcggttagtgaacggaccaaaaaaatgtatgttgaaatgtcgagacaatctggcggatataagaatatcgggtctcttcttcagaccgatgtcagcagtcaggttgataagggtaggtatctagctttggaagaaggagattctcaagtactgcttgagtacttcaagcgtatcaagaaagaaaaccctaaattcttttatgctatagacctgaacgaggaccaacgtttaagaaatctgttttgggctgatgccaagagcagagatgactatttgagtttcaatgatgttgtatcctttgatactacttatgtcaagtttaacgataagttgccactagctttatttattggggtgaaccatcactcccaacctatgttactaggctgtgcattggttgctgatgagtctatggagacttttgtgtggctgataaaaacatggctacgagcaatgggtggtcgagctcctaaagttatactcactgaccaagataaattcttgatgtctgctgtttcagagctcctaccaaacactcgtcattgctttgcgttatggcatgttttagaaaagattcctgaatatttctcacatgtgatgaaacggcacgagaatttcttactgaaattcaacaaatgcattttcagatcttggacagatgatgagtttgatatgaggtggtggaaaatggtcagccagtttggacttgagaatgatgaatggctgctatggttgcatgaacatcgccaaaagtgggtgcccacatttatgagcgatgtgtttctggcaggcatgtcgacatctcaacgttcagaaagtgtgaactctttcttcgataagtacatccataagaaaatcacgctgaaagagttcttgaggcaatacggtgtgattctgcagaataggtacgaagaggaatctgttgcagatttcgatacttgccacaagcaacctgcattgaagtccccctcgccctgggagaagcaaatggcaacaacttacacccacacaatatttaagaaatttcaagtcgaggtcttgggggttgtcgcttgccatcctagaaaggaaaaagaagatgaaaatatggcgacgtttagagttcaagactgtgaaaaagacgatgactttcttgtaacgtggagcaaaactaagtcagaactttgctgcttctgtcgtatgtttgaatacaaagggtttctttgtcggcatgctttgatgattctgcagatgtgtggtttcgccagcatcccgcctcagtatatattgaaaaggtggacaaaagatgctaagagtggagtattagctggtgaaggagcagaccagatacagacccgagttcagcgctataacgatttgtgtagtcgagccactgaattgagtgaggaaggttgtgtgtcagaagaaaactacaacatcgcattgcgcacactagtcgagaccctgaaaaattgtgttgatatgaataatgctagaaacaacatcactgagtctaatagccagcttaataatggtactcacgaagaagaaaaccaggtaatggctggggtaaaagcaacaaaaaagaagactgtatataggaaaagaaagggacaacaagaggctagccaaatgcttgaatctcaacagagcttgcaaccaatggaaactataagttcagaggcgatggacatgaatggttactatggtcctcaacagaacgttcaaggactgttaaatttaatggagccacctcatgaaggctactatgtagatcaacgaaccatccaaggcctgggacaactgaattcgatagcaccggcgcaggatagcttcttcacgaatcagcaagccatgtctgggatggtgggtcaaatcgatttcagacctcctcccaatttcacttacactttacaggaagagcatttgagttctgcccaattacctggtagttcatcaaggcagctatagtagcaacacgttttgattactttggagagaagttttgtctcaggaaacatttgcaagaagctgttccaaacatgagaaaaacacaagatctttcatggagctgagttgcaatgacaagatgtaatcttttcttaaattggtttctgtatattatgggattgccttatgatgtattaatgtgggatgaaatattgtgttatctgattgaatgtcttgagatttaatagatgcacttgtaacaacatctttatctaaacacatagaaatctatcctc

SEQ ID NO: 440 - DNA, 972 bp, Arabidopsis thaliana
gcgtttccttcttacataataaccaaaggagcctcaacagattctttcaaatcaacttctctgtcttcttctcgatctttggttacagatttccatcttttgttctccagacccatctcttccggtcctaaataccaatctgccaagtccgctaaaccggaatctccagtcgccataaactgcttaaccgatgccaaacagttgggaggaggaagagcatgatgatgggcttgctcatgtctggtttaatagtttcacaagccaatcttccaacagcatttgcttcaactccagtgtttagagaatacatagatacatttgatggatactccttcaagtaccctcaaaattggatccaagtccgaggagctggtgctgatatattctttagagaccctgttgtcctcgacgagaacctttcagtcgagttttcttcgccttcttcctcaaattacacgtcacttgaagacttgggatcccctgaagaagtaggaaagagagtacttagacagtacttgactgagtttatgtccactagactcggggttaagcgccaggccaacattctaagcacttcctctagagttgcagatgatggtaaactctactaccaagttgaggtgaacataaagtcatacgcaaacaacaacgagctagctgtgatgccacaagatcgagtggctcgtttggaatggaaccggcgctaccttgcagttctaggagttgagaacgatagactctattcaattagactccaaacacccgagaaagttttcctggaagaagaaaaagatctaagaagagtcatggattcgtttagggtcgagaagatttagaagagctcacattctcaatgtgaatttcttcttattccaaaccaaaaaatcttgttgcttactacttttgattaccaaactaataaatgattttgattcaaattttgagatgtcattatgacatagttgagaaata

SEQ ID NO: 441 - DNA, 2776 bp, Arabidopsis thaliana
aatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttcaaaaagtacctccaatggcttcttctgcatttgcttttccttcttacataataaccaaaggaggactttcaactgattcttgtaaatcaacttctttgtcttcttctagatctttggttacagatcttccatcaccatgtctgaaacccaacaacaattcccattcaaacagaagagcaaaagtgtgtgcttcacttgcagagaagggtgaatattattcaaacagaccaccaactccattacttgacactattaactacccaatccacatgaaaaatctttctgtcaaggaactgaaacaactttctgatgagctgagatcagacgtgatctttaatgtgtcgaaaaccggtggacatttggggtcaagtcttggtgttgtggagcttactgtggctcttcattacattttcaatactccacaagacaagattctttgggatgttggtcatcagtcttatcctcataagattcttactgggagaagaggaaagatgcctacaatgaggcaaaccaatggtctctctggtttcaccaaacgaggagagagtgaacatgattgctttggtactggacacagctcaaccacaatatctgctggtttaggaatggcggtaggaagggatttgaaggggaagaacaacaatgtggttgctgtgattggtgatggtgcgatgacggcaggacaggcttatgaagccatgaacaacgccggatatctagactctgatatgattgtgattcttaatgacaacaagcaagtctcattacctacagctactttggatggaccaagtccacctgttggtgcattgagcagtgctcttagtcggttacagtctaacccggctctcagagagttgagagaagtcgcaaagggtatgacaaagcaaataggcggaccaatgcatcagttggcggctaaggtagatgagtatgctcgaggaatgataagcgggactggatcgtcactgtttgaagaactcggtctttactatattggtccagttgatgggcacaacatagatgatttggtagccattcttaaagaagttaagagtaccagaaccacaggacctgtacttattcatgtggtgacggagaaaggtcgtggttatccttacgcggagagagctgatgacaaataccatggtgttgtgaaatttgatccagcaacgggtagacagttcaaaactactaataagactcaatcttacacaacttactttgcggaggcattagtcgcagaagcagaggtagacaaagatgtggttgcgattcatgcagccatgggaggtggaaccgggttaaatctctttcaacgtcgcttcccaacaagatgtttcgatgtaggaatagcggaacaacacgcagttacttttgctgcgggtttagcctgtgaaggccttaaacccttctgtgcaatctattcgtctttcatgcagcgtgcttatgaccaggttgtccatgatgttgatttgcaaaaattaccggtgagatttgcaatggatagagctggactcgttggagctgatggtccgacacattgtggagctttcgatgtgacatttatggcttgtcttcctaacatgatagtgatggctccatcagatgaagcagatctctttaacatggttgcaactgctgttgcgattgatgatcgtccttcttgtttccgttaccctagaggtaacggtattggagttgcattacctcccggaaacaaaggtgttccaattgagattgggaaaggtagaattttaaaggaaggagagagagttgcgttgttgggttatggctcagcagttcagagctgtttaggagcggctgtaatgctcgaagaacgcggattaaacgtaactgtagcggatgcacggttttgcaagccattggaccgtgctctcattcgcagcttagctaagtcgcacgaggttctgatcacggttgaagaaggttccattggaggttttggctcgcacgttgttcagtttcttgctctcgatggtcttcttgatggcaaactcaagtggagaccaatggtactgcctgatcgatacattgatcacggtgcaccagctgatcaactagctgaagctggactcatgccatctcacatcgcagcaaccgcacttaacttaatcggtgcaccaagggaagctctgttttgagagtaagaatctgttggctaaaacatatgtatacaaacactctaaatgcaacccaaggtttcttctaagtactgatcagaattcccgccgagaagtcctttggcaacagctatatatatttactaagattgtgaagagaaaggcaaaggcaaaggttgtgcaaagattagtattatgataaaactggtatttgttttgtaattttgtttaggattgtgatggagatcgtgttgtacaataatctaacatcttgtaaaaatcaattacatctctttgtgtatctttcatagctttgtgtgacatattttggt

SEQ ID NO: 442 - DNA, 2007 bp, Arabidopsis thaliana
cttcttctccttctctgatcgttcgttttctggacgagagagatggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagagagcagagagcgcattgtctctgcttcggaagaacaaagaatggttttgatattgtcattagtgatgttcatatgcctgacatggatggtttcaagctccttgaacacgttggtttagagatggatttacctgttatcaatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgattggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttgattattactcgaatacagtgcactctaaaac

SEQ ID NO: 443 - DNA, 3495 bp, Arabidopsis thaliana; identical to SEQ ID NO: 224

SEQ ID NO: 444 - DNA, 4732 bp, Arabidopsis thaliana
aaattgatctcatcttcaatcaaattcatcatcttcgatactcgtttcttctctctttggtttcatacagatcccaaatttctagggctcctagtcctttgatttcttcgactggaatcgcaattccccactacgtcaagctggacagacaccgaagggatcgccatgagagtggcggctacgaggattcctaccataaccaccgagcccatcccagaggtccatctcgtccctcagattcacgcttcgaagaggatgatgatgattttcgccgccaccgtcgtcgtcgtggaagcagccctagcaattatcgaattggaattgggggcggaggaggaggtaatggtggtcgacgctgggaagatgacactcctaaggattttgatggtcccggagatggaggtttccggcagatgaatggtcccccagatagagtagattttaagcctatgggtcctcaccatggtggaagttttcggcctatggggtttgcctacgatgatggttttcgtccaatgggtcctaacggtggtgtgggaggagaagggacacggtcaattgttggagctcggtataactatcccgcgaagtatcctccttcagagagtccagacaggaggagatttatcggtaaagcaatggagtctgattattctgtaagaccgactacaccgccggtccagcagcctctttccggtcagaaaagagggtatcctatctcagaccatggcagctttactggaactgatgtctctgatcgtagcagtacagtcaagctttttgttggatctgtaccaaggacagctacagaagaagaaatccgtccctatttcgaacagcatggaaatgttctggaggttgctctgatcaaggacaagagaactggacagcagcaaggtatgtcaatctccattttattaggaaatagtcgtgaattatactttttaaaatttcaggtctccctgaaaaggctgatgggaagcaaccccagtctcatcattggcctccaattgtttgcaacaattttcgggcttattgcttatgcttgccagcgtcttatctgtgttcgattctgtcacagaagaaggctacctgtgctaagaaagggtttatgtacttatgttgggcaaatagatttcgctacttgtgtgtattctagaactttagatgtgtttgaaaagtgtagaatttattgagggtgttttagagttggagttaatgtacagagaactgaattttgctgttgcctttatagtgggaattggttataagaacatcgctattttcctctcctattgaaattcattttctttactcttcctctagatggattgaagatgttgtgtatggtcttgacaggatgaatgtatttttttaagttggtagtttgataaggacatgaggttcaaaagatggtttcttgatttgccactcctgctggtcaaagatttggccgtctttctaattttatcatgttggaggtttggcgtcttcattttctttcatatcaatttatgggtgtgctgtctattggttaatgatggcattccttttacctttttggatgagtgatgctggaatgaatgcgtttctccttttcttttgttgatggcctgaggaactatgatggctatatttctttccactctctttgaatggcctgaaatgtgtgctttctgtatggtcgtccctctcaatttcttggatggcttgtgatgtgatataccatctctcgtcataggtgaatgaatgatttgtttagtagttcttatgtatgtattttgtatgttcccacgtctctattccttggatggcttgtgatgtgatataccatctctcgtcatagatgaatgaatattttgttgagtagctcttatgtctgtatggtggcccttgcagtgctgatcgatatttatgtggaagaaatgtttgatgatagattttttttgtatgctcccttttcgctaatcaagcctttgtgcttgcaaggtgcaactgttattttattattgaatttcctgttctactactccatttagttctgtctctattttgtcagtgtgaagaaatactagacgatgaatggtgtgtttgtacgtgcatagttatttataaattcttgactttccaagaagttattatttctataactgctacacctttgtggatggcagaacaaatgcatctgattgtggtgacataaacacttttgatcgcggttgaatgtactagattccatacaactctttcttcagccttgtgaaatattattatgttaggtggtgcaaacatatggaaggaacctgattgttttagtttcttagaatagtttctgatgttaatacagcatgttgacttcactctcttgcccttgatcaatcagcatcaggcaggggcctaattatgtattacatgaagcaatcgtattcttttctgaattagatttttttccaatgagttatcttgcccataactgtagttctttatttgaagtcttcaaatgcttgatgtatggtgacgaaaatgtgtatatgttttggttttgattatccgctactcatcaattattgagattcttacatactgaatccgttactttggacctatagttatgttttatgttgctaattaacttgtacatgtttctagattttctttcaaatggatcctgcttggacaaatgcagccaccctttgtctgaaaggccctcttgtagatatgttatctgcagatactgactgtgttcaattttttaatatttgtttttgccatattctccatttgaagacattaatttattctctccaacaactttacatcaatatttaagtggaggctgtcagacatgtcttatgattttcctactgaacttatgtgctttgagtagtacatcttgttactagtacaatttgatggtagaaggaaaagttgaaccctgaaacagatagcttaagtatcagtctttaatgcaggctgttgttttgtaaaatatgcaacttcgaaagatgcggatagagccatcagagcactgcacaatcagatcactcttcctgggggaactggtcctgttcaagttcgatatgctgacggggagagagaacgcataggcaccctagagtttaagctttttgttggttcactaaacaagcaagccactgaaaaagaagttgaggagatctttttacaatttggtcatgtggaagatgtctatctcatgcgggatgaatatagacagagtcgtggatgtgggtttgttaaatattcaagcaaagagacggcaatggcagctatcgatggtctcaacggaacttataccatgagaggttgcaatcagccattgattgttcggtttgctgagccaaagaggcctaaacctggcgagtcaagggaaatggcacctcctgttggacttggttcagggcctcgttttcaagcttcaggaccaaggcctacctctaactttggtgactctagtggggatgtaagccacacaaatccttggcgtccagctacttcacgaaacgtaggcccacctagtaacactgggatccgtggtgccggtagtgacttttcccctaaaccaggtcaagcaacattgccttcaaatcagggtggcccgttaggtggttatggtgttcctccccttaaccctctcccagtccctggagtttcatcttctgccacattgcaacagcaaaatcgggcagctggccagcatataacaccattaaaaaaacctcttcacagtccacagggtctccctctccccctccgtccgcaaactaatttccctggggcccaggcacccttgcagaatccttatgcttatagcagccagttgcctacctctcagctgccaccacagcaaaacatcagtcgtgcaactgctcctcaaactcctttgaacattaatctacggccaacaactgtgtcttctgcaactgttcaatttccccctcgttcccagcagcaaccgctacaaaagatgcaacatcctccttctgagctagctcagctcttgtcgcagcaaactcagagtctacaagcaacattccaatcgtctcagcaagcaatttctcagctgcagcagcaggtgcagtctatgcagcaaccaaaccaaaatttaccactctcacagaatggccgagctggtaaacaacagtgggctggatctgcaattccaagagtggctagcaccactggttcgacaccagtgagctatgtgcaaacagctgcacctgcagtaagtcagagcgtaggttctgtcaaatgtacctggaccgagcatacctcgcctgatggatttaaatattattacaatggtctaacgggtgaaagcaagtgggaaaaacctgaggaaatgatagtgttcgaacgagagcaacagaaacagcaacaacatcaagagaagccaactatacagcagtcccagacccaattacagccgttgcagcaacaaccacaacaagttcagcagcaatatcagggccagcaattacagcagccgttttattcttcactgtatccaactccaggggccagccataatactcagtatccatcattgccagtaggtcaaaatagccagtttcctatgtcaggaattggtcagaatgctcaggattatgctcggacacatatacccgtgggagctgcttcaatgaatgatatatcaagaactcaacagagccgtcaatctccccaagaactcatgtggaagaataaagcttga

SEQ ID NO: 445 - DNA, 843 bp, Arabidopsis thaliana
ttcctactctcacactccaaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaa

SEQ ID NO: 446 - DNA, 1608 bp, Arabidopsis thaliana
tatctccttatcctgaccacagaaacaaacataagccaatggaaacaaaaaaattctaaggtgaaaaaagccaatcagaagctgagtaaactctaagctcacacaaaaatggcgtctcttcttggaacatcttcttctgcaatctgggcttctccttcactctcttctccttcctcaaaaccttcctcctcccccatttgcttcaggccaggaaaattgtttggaagcaagttaaatgcaggaatccaaataaggccaaagaagaacaggtctcgttaccatgtttcggttatgaatgtagccactgaaatcaactctactgaacaagtagtagggaagtttgattcaaagaagagtgcgagaccggtttatccatttgcagctatagtagggcaagatgagatgaagttatgtcttttgttgaatgttattgatccaaagattggtggtgttatgattatgggagatagaggaactggaaaatctacaactgttagatcattagttgatctgttacctgagattaatgtagttgcaggtgacccgtataactcggatccgatagatcctgagtttatgggtgttgaagtaagagagagagttgagaaaggagagcaagttcctgttattgcgactaagattaatatggttgatcttcctttgggtgcaacagaagatagagtttgtggaaccatcgatatcgaaaaggctttgacagaaggtgtaaaagcctttgagcctggtttgttggctaaagctaatagagggattctttatgttgatgaagttaatctcttggatgatcatttggttgatgttcttttggattcagctgcttctggttggaatacggttgagagagaagggatttcgatttctcacccggcgaggtttatcttgatcggttcaggaaatccggaagaaggagagcttaggccacagcttcttgatcggtttggtatgcatgcacaagtagggacggttagagatgctgatttacgggtcaagattgttgaagagagagctcgtttcgatagtaacccaaaggatttccgtgacacttacaaaaccgagcaggacaagcttcaagaccagatttcaactgctagggcaaacctttcctcggttcagattgatagggaattgaaggtgaagatctctagagtttgttcagagctcaatgttgatgggttgagaggagacatagtgactaacagagcagcaaaagcacttgcagctctcaaaggaaaagatcgagtaactccagatgatgttgcaaccgttatccctaactgcttaaggcaccgtctgaggaaagatccactggaatctattgattcaggagttctagtttccgagaagttcgccgagattttcagctgaataggagattcgattctgtgatcatttttctttaactttttctactctgtaaacggtgagaagaaccaaaactataaacaggcaaatctgattgaatatagagtctatgctttattcattaagttgagttgttcaaacttcaaatcatagactcaatagaactctgtttatatttgtgtaactacatacaaacattcctgcattgattatggctataaagctatc

SEQ ID NO: 447 - DNA, 1532 bp, Arabidopsis thaliana
ctaaatgtactgaaaagaaacaccagtttaattaattatacttccctcatatataactatcaaccaagtacaaaacttttgtcaattctcaaaatcaactttcaccacataattatctaacatgtgtatgttccaaaaccagtttaaatagaattacttttcagaaaatacatgtatattaactctatctaataaagaagaaacacatacttatctcatagattccattcataaaactatgctttagtgagtaagaaaaccagtaatcaaacacaaattgacaagacactatatggatgtaaaaagtggggaaaaatggtgataaatagtagagaaaattaaaaagaaaaaaaatattcctttataaatgtatatacccatctcttcaccagcacaaccttaccttccattttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctttgtgatgctgaagtcgcactcatcgtcttctctagccgtggtcgtctctatgagtactctaacaacagtgtaaaagggactattgagaggtacaagaaggcaatatcggacaattctaacaccggatcggtggcagaaattaatgcacagtattatcaacaagaatcagccaaattgcgtcaacaaataatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagagaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgcgggtcgccaagaccaaaccgctctccagttagtgtaatataggctgaaggaaatggccgggagtgaataaaaaccagaattgggttgagcaagcaatataaagctaatgcatgttatatatatatttatcccatgaatgttgtatcagtgaattttatgcttatgttgatgtgaaattaatatcttaaagacatgtcattaatgtgcttaatttgcttcaaaacatctatgtgtataagtgtactattagttcaattgttgtatttaattaccaattcctgctctattaatgattttattatag

SEQ ID NO: 448 - DNA, 815 bp, Arabidopsis thaliana
gtacatttgtttttaaccagttagcaacttcttcttccggaatctttaaaccaacaaaaaaaagttatcattcgggttaagatggagaaaccgggtcatgaaacggatattgcgggttcaagacgaacccatctgaagaaatcattcaaatccactcttcgacatcttctcactgcttgctccaaacaggattttgttgatattttctcgaaattcagtggggctgagcaagaactgctttttcagttgtatactcgggttgttgtgaatttgcatcagacaatagaggaagagtttgatgaacaatgtcacgaaactcaggtcggaccaattcttgatacagtcgaggagctggtcgaagaacagagtttggatcccttgttttctgataagactgatgtaatggcaatagcatatgatcttacaacatctaagaagaacgagatacaaaagttaacagttttgctccaaagggctgaagaacagaatcgccagaaggaagcccggatcagcatgctcaaaaaacaaacacaagatctctcaggcacagcggacagaatcgaaaagctgaatgccggggtctccggctactttgaaggaaaagacaagctacctccaatatagtttcgagaaaattgcaatgaagaagcgtgtcatttccattccctgcatttgtatatactttattatagagtcttaacaatctagtcagtagtcacaataacttgcttcatgtgtaaaccactgagaatctgaatgagtttgtactttggtattggtttgacgacaattcatgcaaaatattttccaaggtt

SEQ ID NO: 449 - DNA, 1864 bp, Arabidopsis thaliana
gactcttctctctttcgctcgtcgctgcgaaagagcatttgttttcgtttacgcgtttctttttctcgttgagtgcatttgttctagaatttgtgtattagtctaagaagatcattactgtttacataccaccaatggatgaagcattgaatgagaatgcttctggcagtgagagcgatgcttcgtcagtcgcgagcaatctccatgatgatgagattatcccttggttcttttcaagagaagagatcgaaagaaactcaccgtcaaggcgagatggtattgatttgaagactgaaactcgcctacgcgactcatactgtacatttttggaaatactcggcgaaagattgaaagttccccaggtaacaatagccactgctatatttttctgtcaccgattcttccttcgtcaatcacatgcgaaaaatgacagacagacgattgcaacagtctgcatgctcctagctgggaaggttgaggaaactccagtgacattagaagacgttattattgcctcatatgagagaatacacaagaaggatcttgctggtgctcagagaaaggaagtatatgaccaacagaaagagcttgtattaatcggagaggagcttgttctttctacattgaactttgatctctgtattagccacccttataaacctcttgtagaagcaattaagaaatatatggttgaagatgctaagacccaacttgcccaatttgcatggaattttgtcaacgattgtctgcgaacgacactctgcctgcagtatcagcctcatcacatagcggcaggtgctattctccttgctgctgagctgccaacagtggacttacaatcttacagagaggtcttgtgtcaagagtttgatatcacaccttgtcaattagaagatatccgaggccaaatacttgagctttatgagagaattcctacatctcaagaaagcaaagttgaaagtagtggtggtgtggccgtagtgcatcaacctatatctagagatatggcttccacagagaagtgtccaagttctgatattgaaggaggctcatcgcaagtcaatctaagccagagcgatgatcattcagtccacgatgggtctaggtctgaaggaattggagaggtgaactcagaaagtgaagctcaaaagaatctacaggaccattctgttggtaatataatggttgagaaaagtgatgatgttggggtcgtccaattgaagaaagacttgcaactgcatcaagaggaggttgagtctaaacaagagaaagataagaagtcatttgaaaaagatataacgaaaatagatttgatggatgagaaggatttgactgaaagtgaagtagaagatgagattaacaaaacaatgcagacaggaagacaaatctttatgaaagttgaggaccctgatgacaacatgactgtcgaacacagtgagattcgaaatgcaaacaactcaggtgttgatgatgaattggtggctgatacttgtctgataaatgacagtgatttgtaggaaatggtcgttgaagatggtgaaatagtggtttagatgtttagctcagaagctttcgaagagaaccagttttggtcctgagaagagctttttaactaggtgagttttggagagacaactattatatgttttctccaaaagacgaaggtttagtttcaagatttgtggtagatcatgactttgaatcttttctcactcttaagacttttaactacagtggaacgagagcaagttctccttgcatcgtcaatgtgttgtgtaatgtcctaaagttctcttaaacattgtggtatagtttcaagatttgtggtagatccttttcattcaagtaaattgggtttcatgac

SEQ ID NO: 450 - DNA, 1622 bp, Arabidopsis thaliana
tcagccattctcttatttggctcattcgattattataggaggaaaccatggagctaaggaaatctcaagtggccatgcctgttttcttggcaataatgagtctaatggtgagtcaagtggtcttcgccgagaaagattcaggttcaatgtcccctcatgatcgggcattagcagaaatgcaagcccttaaagcttcattggttcggcgaaatctaccggctttggtatctcctcctcctacccctcctcaggccgtacccggtccgcgcgtgtaccaagtgatatcatatggtgccgatcccacagggaaattggatagcacggatgcaatattaaaagctatggaagaagcatttgatggtccaaatcatggagttttgatgcaaggtataaatgatctcggaggagcaagaattgatcttcaaggtggaagctacttaatcagccgtcctctacggtttccctcagccggcgccggaaatcttcttataagcggaggtacattaagagcatcaaatgatttcccggtcgataggtacttaatcgaactcaaagacgaatcgtcaaagttacaatacatcttcgaatacataactctcagagatcttctcatcgattgcaactaccgcggcggagcaatcgccgtcatcaactctctccggacaagcatagacaactgttacatcacacggttcggagacacgaacgggattcttgtcaaaagtggacacgagacttatatccgaaactcgtttcttggtcaacacataaccgccggtggagacagaggagaaagaagcttttccggcaccgccatcaatttgatgggaaacgataacgccgttactgacaccgttatattctccgccaggatcggagtaatggtatcgggacaagctaacttattgtccggcgtgcattgctataacaaagcaaccggttttggaggaaccgggatttatttgagattacccggtttaactcagaaccggattgtgaattcgtatttggattataccggtatcgtcgcggaagatccggttcagttacagatttcagggacgttttttttgggagatgcgtttattttgttgaaatcgatagccggatatattcgtggggttagtattgttgacaatatgttttccgggtcgggtcatggggtccagattgttcaattggatcagaggaacactgcgtttgatgacgttggccaggtggtcgttgaccgtaacagtgtgaacggaatggtagagaaatcgacggtggctagaggttcggtagatggaaacgggacgtcttggaccgttgattttaacccggttttgttgttcccggatttaatcaaccacgtgcagtacacacttgtggcgagtgaagctggcgtgtttcctctgcacgcgctaaggaacgtttctgataaccgggtggtcgttgagacaaacgctcctgttactgggacagtttatgtaacagtgaatcaaggagtttaatgtcgtgtttttgccgtttaatggttttataattttataaaatgatttatacttgttggtttttatttgtaatttttcctgtaagggggaaatttattttttatacagctaataaatgataaaaactcg

SEQ ID NO: 451 - DNA, 3405 bp, Arabidopsis thaliana
atggagaaggtttcagcagcttgcgccatggaatggagcatcaagctcgagaaatctcttcgttctaaaaactcagttaaagccgttgaagctatcttagagactggtgggaagcttgaacagtggagtaaagaaccagaatctgctattgctgtttacaatttatttggtttggttcctgaagaagataagctcttttcaaatactatcctgttgaggcttgttgacgcgttttgtgttggggataagcttattaagcttgctgttgttcgggtttttatgtctatgtttaagctaagccgagggaagaacgtaaatgaatcagcaagttggtttttgtcaaagggtagggtgcataaccacttggaattgcttacacgagtgaagaatgtgtatgataagggtgatactgagtctaaagctttggctttgattctgtttggttgttggagagattttgctagcgaatttgctcctgtacggtatttggttttcagcagtatggtttctcctcatgatctggagggaagatcagctctgtttgctgcagcttgcttttgtgaagtagcagatgactttgcattggttgttctggggatgttaaacgacatggtgaagttcccagacataacgccaaagaccaggttagctgctgtgcgagtttttgcaaaaatgggatgctcgcatacaattgctaatagagcattcaagatttgtatgaagctaatgctggactccccaaaagaggacaatttggttccattcctggtttccttgactaagcttgcttcaagatcaactcatcttgcttctgaactggcagaggttatcataccctttctgggtgaagataaaacttctcatgctcgagctgcagtattgagatgtctccactttctcatagaaagagggatgtgcttctctcttgcccatgaaagagatattgcaagtgtttcaagcttattaaagcaagaagagctctcatcagatatgcaagttaaagctcttcaaatttttcagaagatagttgtctacaaactatgcatgactgatgcatctgaattacttcagctcatagctattactgagaatgcatctcattctcagatcttttcaagcagttgtttagccatcagtgtcttggtgagtatatggacagaaatagttcggacagcggaaaaaagatcaattgagatatcttcaacatctcttccgatgcagctcgttgtattaatcatggacagggtcgccttgctggggcgattatgttctgatctttttcgagctggctatgctgtagttagtgaggttcaagacctcttgaaggttctccacctattagtaggaaaacattctgaactgagactgctagttcttgaaaaagtcagattattcttaacgtatattgtgagcctaaatgatggcttaagaaaagcagatggagctcatgaattgctatttggtgttatcaattataaagacaaaagaggggtggtcatgaggtcagagtttctagcatcaatacacaagttcctgatagtgttcttggaaaatctcgagggagatgataatcttttgtctgaaatttatgaaaaggtgaagcatatcactgagtttgtaagttcatgcagcttcattgatttccacacacaaatgatattcacactgctactacattccccgattctttggggattctctgtgaatgatgatacaggaaattcaggcgtatcacttgttgctgatatagttaactatggaatcgtttctcttgactgttcaaatcagattttaatggagagaaactactggcctgcttacagagctggggtttacgcagcacgtttgggtgcttgggtcacatctgctatgatttttgaccagctcaaaaccaacgtccagtctgatattaattgttgctggttaaagtcattaacctatttatcccatgccgagggaaaattccaactgcttctcactccaagtgatagtgtcaagttagtcaattggctgaaaaataatggttatttaccagaactctccaaagatgcctctggagagtttgcacactgtctagctcttcgtgaagcttatatgaatttacaatcgtctctgggaatgttgggaaatattatagcgtcaagtggagtattctgtttccaaacgtggttcttggttctaaagactcgggtattggaaaccgtgcttgaactcgtcgaatgccttgggctgcttaaccaagatttacgcaacaagaatcaggtggaagaaatactcttgactggttgcgattccctgcaacagcttcctcggatttctattcagctacaaaagttggcaaaggaatttgatatgttggcgacgtgtttcatagacatagacgatagcagttctagcattatcacaacaatttcactgagctgttcagttctggcttttgctgctggaattgttcttttccttccaggtttttcttttcaagaagcattggttcctttcacttcacaaagcggtctgtgctcgaggcttgtagaagatttagttcgacggctgtggaaagtagaccccaatgtctgcgaaaagctcaacatactcgttaacacaaacgagtcgttaaactgtttccatttgcaatctaggaatcaggttttgagagtctgtggcaaagtaaagatgctgctctctatttgcagagatgctctttcatgcacttatggattgcagaatcagtcaatgtcaatgcacaaagaggagattatgtctgagattacgaaaagttgcaggcatctactgtcacaagcaattatgaaatggatgcagattccttttggtattccaaagtatttcttcaacataaggccttgtgttggtgccgagctatttgctcttagttcagagagtagcaaacgtattcctgacacagtttcagtggaacaagggtttcaactgtcactagatctttgtcttcagttgaaaaacataaaacaacggcaagtccctgttcgacttaacaaactgtattgccttctctatactaaactagcttatcattctccaactcaacacggtgaaaacaacagaaaccaaatgtcttattccccttggagagatgaagatctgattgaaatgagtaacaagctgtttcatcatgctataaagtctggtaagaagccggacgtctcaggtcgatttgattgggccaagagtggtgtttctacggttgtgcagttcgaaccaaacgagagaggacaagggttttcaagctgcttgttagacgtttcgcgtttcccggttggttcatatcaaataaaatggctaagctgttgcgttgatcaacatggttcttactggaatcttctacctctcaatggcaaacctgtgtttacggttaagaaagcgtcatga

SEQ ID NO: 452 - DNA, 3125 bp, Arabidopsis thaliana
atttcaggggtatgcacattttgcataaaagttccaatctttcctgatcgttgacaatatttatgtgtacccttttgtttgtctcagtgtgttaaagaagctacattgtgtttgtgatggccggtggtgggaagcatactcctactccaaaggcgattatacatcagaagtttggtgctaaagcaagctatacagttgaggaagttcatgactcttctcagagtggttgtctaggattagcaattcctcaaaaaggtccatgtctctatcgttgccacttgcagctacctgaattttctgttgtgtcaaatgtcttcaagaagaagaaggattctgaacaatctgctgctgaattggctcttgacaagctaggcattcgccctcagaatgatgatcttactgtggatgaagctagggatgaaattgttggacgcattaagtatatattttctgatgagtttctttcagctgagcatcctctgggagctcaccttagagcggcattgcgaagagatggtgaacgttgtggatcagttcccgtttctgtcattgctacagttgatgcaaagattaacagtcgttgtaaaattatcaatccttctgtggagtcagatcctttcttggccatttcctatgttatgaaggctgctgcaaagttggcagactacattgttgcatctccgcatggactccgaaggaaaaatgcatacccttcagaaatcgtggaagcactagctactcatgtatctgattccctacatagcagagaagtcgcggctgtatatataccatgtatcgatgaggaagttgttgagttagatactctttacatttcatcaaaccggcattacttggatagtattgctgaaaggctcggattgaaagatggcaaccaagtgatgatatccaggatgtttggcaaagcttcctgtggctctgagtgtagattgtactctgagattccaaagaagtacttggataattcatcagatgcctctggtacttcaaatgaagactcatctcatattgtaaaatctcggaatgcacgagcaagttacatttgtggtcaagatattcacggggatgcaatcttggcatctgttggttaccgatggaagtccgatgatcttgactatgatgatgtaaccgtaaattcattttacagaatatgttgcggtatgtcacccaatggaatctacaaaatttcccgacaagctgtaattgctgcacagttgccttttgcattcactacaaaatctaattggagaggtccactccccagggagattctcggcctgttctgccaccagcaccgactagcagaacccatcctttcttcatctactgcacctgtgaaatcgttgtccgacatattcagatctcacaagaagttgaaggtctcaggagttgatgatgccaatgagaatttgagtaggcaaaaagaagatacaccaggactagggcatgggtttagatgtgaagtgaagatttttacaaagtctcaggatttagttttagaatgttcaccgagaaaattctatgagaaggaaaatgatgccattcaaaatgcttcattaaaggccctcttatggtttagtaagttttttgctgacctggatgtggatggagagcaatcatgtgatacagatgacgaccaggatactaaatcttcaagtcctaatgtttttgcggccccaccgattttacaaaaggaacacagttctgaatcaaaaaacacaaatgtgctgtcggcagagaagcgtgttcaatctataacaaatggttccgtggttagcatatgctattctttgtctttggcagtggatcctgaatattcgagtgatggtgaatctccaagagaagacaatgaaagcaatgaagagatggagtctgaatattcggctaattgtgaatcctcagtagagctcattgaaagcaatgaagagatagagtttgaggtagggactggatccatgaatccacatattgaatcagaagttactcagatgactgtgggtgaatatgcttcatttaggatgacaccccctgatgctgctgaagctttgattttggctgttggttctgatactgtgagaatccgctcgctcctatcagaacgtccatgtttaaattacaatatacttttgttgggagtgaaagggccatcagaagaacgaatggaggcggcttttttcaaacctccactttcaaaacaacgtgttgaatatgcactgaaacatataagagaatcatccgcttctactttggttgactttggatgcggatctggaagtttattagactctctacttgactatccaacttcacttcaaaccatcatcggtgttgacatttcgccaaagggtcttgcccgtgctgctaagatgctacatgtaaaactaaacaaggaagcttgcaacgtcaaatctgctacactttatgatggttccatccttgagtttgactccaggctgcatgacgttgacatcggcacttgcttagaggttattgaacacatggaagaagatcaagcctgtgaatttggggaaaaagttctgagcttgttccaccccaagctcctgattgtctcaacaccaaactacgagttcaacacaattctccagcggtctacaccagaaacccaagaagaaaacaactcggagccacagcttccaaagttcaggaaccatgaccacaaattcgagtggacaagagaacagttcaatcaatgggcatcaaagctcggcaaacgccataactacagcgtcgagtttagcggtgttggtgggtctggtgaagtagaacccggatttgcttctcagatagctatttttagacgggaagcttcatctgttgagaatgttgcagaaagctcaatgcagccttataaagtcatctgggagtggaagaaagaagatgtagaaaagaaaaagactgatctttgactagagtagtatctaccagagaatatatatattgcaagcaatgtgatgacgtgttcatctataaaactcaaagctcgtttagttcttttgccatgagcttttgcagattaaccataaaatcgaacctttatgtttacaagatccttttgtctccaagtctactggtccgttgaagtttaa

SEQ ID NO: 453 - DNA, 2849 bp, Arabidopsis thaliana
gaaactacaggctcctgcttcagtcacacacttacacacacacaaaaatccccaaattaggaaaaagtaagaatcctagtttctcgacttcgattgagaaggttttcgatttgattctctaagatcttgagaatcaatcggagattttattgtcggtaacccgaatttagggagaagactaccattttgggatttttatgcacttgacgagcgaaaggagaagaaatttgtagcaattttgagtctcggagatggcttctcgcaaccagaatcgtcctcctcgcagtccaaacgccaaaaaggagggtctcggtggcatttcatttgacaagcgaaggaaagtggaaacgcaaggaggtactgggagaagacaagctttttcggctgtgaataaacaagatgtcacgatgaacagcgatgtagggagcattgaagaatgtggtaaagttgactttacaaaagatgaaatattggcgttgctcagtgagagagcaaaagctggaaagtttgatactaaggctaagattgagcaaatgacggatattatcaagaggctgaaggtttgtgtaaaatggttccaacaagctgatgaaacccatgtccaagagaaggaaaatttgaaggtttctttggaatcttcagaacaaaaatacaaccacaaagagttggaggctaggacaaaagaggaagagctacaggccactatctcaaagttggaagagaatgtagtgtcactacatgaaaagcttgcaaaggaggagtctagtacacaggacgccattgaatgtcatagaagagaaaaagaagctagagttgcagctgaaaaagtgcaggcttctctcggagaagaacttgataaagttaaggaagagaaaatggctgccaagcagaaggtgacgtcacttgaggatatgtacaaaaggctgcaagagtacaacacaagtttgcaacaatataacagcaaacttcagactgatcttgaaacagttcgagctgcactcacacgtgctgaaaaagagaagtcaagcatcctggagaatcttagtacacttaggggacacagcaagtcgctgcaggatcaactatcttcaagcagagtgttgcaagatgacgctataaaacagaaggattcattgctttcggaagttactaatcttcggaatgagctccaacaagtccgggatgaccgtgatcgccaagttgtacagtcacagaagctgtctgaggagatcaggaagtaccaggagaatgtcggaaagtcatcgcaagagctagacatcttgacagcaaaatcaggatcgttggaggagacatgttcgttgcagaaggagcgtttaaatatgttagagcagcaattagcaatcgccaatgaaaggcaaaagatggcagatgcatcagtatctcttactaggacagagtttgaggagcagaagcatctactgtgcgaactacaagaccggcttgcagacatggagcatcaactgtgtgagggagagttattgcggaagaagcttcataacactattcttgaattaaaaggaaatatacgtgtcttctgccgagtgcgtcccttgttaccagacgatggaggacgacatgaagcaactgtaatagcctatcctacttcaacagaagcccaaggaagaggtgttgatttggttcagagtgggaacaaacatcctttcacctttgacaaagttttcaaccacgaagcttcccaggaggaagtattctttgaaatatctcaacttgtacagagtgcattggatggctataaggtttgtatctttgcctacggtcagaccggttctggaaagacctacaccatgatgggccggcctgaggcgccagatcagaaaggactgatccctcgatcacttgaacagatattccaagccagtcaatcactcggtgcacaaggctggaagtacaagatgcaggtatcgatgttggagatatataatgagaccatcagagatttgctctctacaaatcgaacaacttctatggacttggtgcgagcagacagtggcacctcaggaaagcaatatacaatcactcatgacgtaaatggacacacccatgtcagcgacttgaccatatttgatgtgtgcagcgttggaaagatatcctcactcttgcagcaggctgctcagagcaggtcagtagggaagactcaaatgaatgagcaatcatctagaagtcatttcgtgtttactatgaggatttcaggtgttaatgagagcaccgaacagcaggtacaaggtgttctcaacctaatagatcttgctggaagcgagaggctatcgaagagtggggcaactggagatcgattaaaagagacacaggctataaacaaaagtttatcagctttgagtgatgtaatatttgcattggctaagaaagaagatcatgttcctttcagaaactcaaagctaacatatctgctccagccttgcctaggaggagattcaaagaccttgatgttcgtaaacatttcgcctgacccaacttctgctggagagtctctttgctcactccggtttgctgctagagtaaatgcgtgtgaaattggtatacctaggcgacaaacttcaacgaagctccttgactctcgcttaagctatggctaaaaatgttcagaagatctgccaattattgattcacaactcttctcttgtgggttttgacacatcaatctcttatcttgtaacctcttaaactcattactaacattttttccggatctttatgatagtagagcagcttgctgtcttagcaatgtggctttctctatgttgtatgagaaacataatcctctgctattcaatgtttaaatgtattttttc

SEQ ID NO: 454 - DNA, 1482 bp, Arabidopsis thaliana
atgaggatgcttcttgggattccttacgtagacaagtcggttctttccaactctgttcttgagagaggcaagcaggataaaagcaaactattgttagtcgacaaatgccattatgagcttgatgttgaagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatgtggatacatataggagtggaatgtttagtatttatgctgattacaagaatctgccgttgtctatgtggatgacagtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaa

SEQ ID NO: 455 - DNA, 1189 bp, Arabidopsis thaliana
ctctcactgcaagagcgcgaaacagaattccccaacgcgactagattcaatgtaactccacggagcagagccgccaccgtcgtcgcggcatccgtcaccgacctagccggggtcgacagtacaacaatcgccgtactcggtggaggatccgtagcagcactcgcggcgatggtttccttaacggatccggagaggaggcggaaattgcaggcggaggaagttggcggaggcgataaggaggttgtgagggagtatttcaatagcacggggttcgagaggtggaggaagatctacggtgagactgatgaagtgaatcgagtacagaaggatattcgactcggtcatgctaagacggtggagaacacgatgcttatgctgactgaagatagatccttggccggtgtcacggtttgcgacgccggttgtggaaccggtttgctctcgattccacttgctaaggaaggagcaatcgtctctgcttccgatatttctgctgctatggttgctgaagctgagatgaaggcaaaggcacaactaccatcagagaatttaccaaaatttgaggtgaatgatttggagagcctaactgggaagtatgataccgttgtatgtctcgacgtgttgatacattacccgcagaacaaagcagacggaatgatcgcacatcttgcttctttagcagagaagagagtgattctgagttttgctccaaagactttttactatgatatcttaaagagaattggagagcttttcccagggccatcaaaagctacaagggcgtatctacactcggaggcggatgtggaaagagcgttgggtaaagtcggctggaaaatcagcaagagaggactcactaccacacagttctacttctctaggctcatcgaagctgttccaatgtagaccaatttgaaaactagtagatctctgtatagcatattccgagaaggattttcgtggaagacatgcagattctcctaaattcgctgaagagattctcataaactcttcttatatactaggaggacggtctgtacaaacttgcacttctgcagaccctaattgataattggccaaaatgttcaatgtaatcaacgttatttgttgtgctgcttaactgtgtccaaaaacatgtctatacttttctacccattcttgtgcatagtttaaaataaaaaggaaattg

SEQ ID NO: 456 - DNA, 949 bp, Arabidopsis thaliana
ctgtctatctatctctctcgctcgcataaaaggttaacctcaaaacaagtagctcctccttccattaggatggcggcaggactctcaaccgccgttacattcaaaccactccaccgctctttctcctcctcctctaccgatttccgactccgcctcccgaaatccttatccggattctctccgtctcttcgatttaaacgcttttctgtctgttacgtcgtcgaagaacggagacagaattctccgattgagaacgatgagagaccggagagcacgagctccacaaacgctatagacgctgagtatctggcgttgcgtttggcggagaaattggagaggaagaaatcggagaggtccacttatctaatcgctgctatgttgtcgagctttggtatcacttctatggctgttatggctgtttactacagattctcttggcaaatggagggaggtgagatctcaatgttggaaatgtttggtacatttgctctctctgttggtgctgctgttggtatggaattctgggcaagatgggctcatagagctctgtggcacgcttctctatggaatatgcatgagtcacatcacaaaccaagagaaggaccgtttgagctaaacgatgtttttgctatagtgaacgctggtccagcgattggtctcctctcttatggattcttcaataaaggactcgttcctggtctctgctttggcgccgtaagtccctctttcatttggtcttactaaataaaacgcacaaaaccaacttccaagatctttgactctatggtttggtctttttgttttaattagtttaaacactaactaatcaccagaattaggacatttcggtgcctttttttaatcgctacttaatgttagaaaataaaaataataatagtagtggactgagattaatcatacgttaaaacagaattttaattaacgtatc

SEQ ID NO: 457 - DNA, 1444 bp, Arabidopsis thaliana
ctcagaaaaagtgaagaaggagagctttcatcatcatctcagtctctctcgaagtttcaagttcgcgactatggcagcagcgatgtcttcttcttgttgcgcttcctcgcttcgtttaatcccattcaaacggaccttgttttcttcaatccattatccggccaaaacccttcttctacgaccactaaaaccgtcggaagttccttcctttcgccggacgatcatcactttccagaaaatttcaaccgggattgttcctccaccatcggcttcatcatctccgtcgagctatggagaccttcaaccaatcgaagagcttccaccgaagctacaagagatcgtcaagcttttccaatcggtacaagagccaaaggctaaatacgagcagcttatgttctacgggaagaatctgacacctctcgattctcaattcaagacgagggagaataaagtagaaggatgtgtttctcaggtttgggttagggctttctttgatgaggaacgtaatgttgtgtatgaagctgattctgattcggttctcactaaagggttagctgctctattagtcaagggtttatctggaagacctgtccctgagattttgaggataacacctgatttcgctgttcttctcgggttgcagcagagtctgtctccttctagaaacaatggattacttaatatgcttaagctgatgcagaaaaaggctcttcatttggaagtcaaaggtgaggaagattcaagttctggagagagttcagaatccagctttgtgtctattcctgagactaaggacgaagctaatgttccggaggtggatttggagtctaaacctgatctagttgaggatttgggaacagaaaagattgatgattctgagagtgggtcaaatgttgttgctttagggagtagagggatgaggataagagagaaattggagaaggagctagatcctgttgagttagaagttgaagatgtttcttaccagcacgcaggacatgccgctgttagaggtagtgctggtgatgatggggaaacacatttcaacttgcgaatcgtttcggatgctttccaaggtaaaagcttggtcaagagacataggctgatatatgacttgttgcaagatgagttgaagagcgggttacatgctctctctattgtggcaaagactcctgctgaggtttgagggtgtaacattggaagaagtcaggtcctgattcttttacttcttttggtccatttgctttggatattgttctctggaccttctaataatgttaagagctcgatcaggattgtgttaaatgagagatagatattgaaggatataaataatgttttcgccaatcgccacatgattcaccattttcaaactgatttccctttatcttatgagggtcaaggtcttttttgttttgatatggtttcctgatattaagttttg

SEQ ID NO: 458 - DNA, 992 bp, Arabidopsis thaliana
aagcaccacatgttcagattttttcctaacaagaagaaaagaagtcgcagtttcatcgtctttcttccattatcgtgcaattaaattctctcattttcaagaaaatatctgaaaaaacagaaacttaacagaagcagcttcgatcaagagatggcttcacttacttcaatagccacgccttacccatcttcatcgcaggctttgcgtctgaaatcctccggaaacactcttttctctgccggagttcgatcggcagcaatggtttccggtcacaaaacgcttaagattcaatgcacttcaaccaaacctgccaaacctgcagctgaagtcgattggagacagaagagagagcttctattggagaaaagggtgagaagtgtggacgtgaaggaagctcaacggttacaaaaagaaaacaactttgtgattcttgatgtaagaccagaggcagagtacaaggcgggtcatcctccgggagctatcaatgtggagatgtacagactcataagggaatggacggcatgggacatagctcgccgtcttggctttgctttctttggtatcttctctggcacagaagagaaccctgagtttattcaaagtgtagaagctaaacttgacaaagaggcaaagatcatagtagcttgttcatccgcgggtacaatgaagccgacacaaaatcttcccgaaggccaacaatcgaggtctctcatagctgcttatcttctggtccttaacggctataagaacgtatttcacctagaaggtggaatctacacatggggcaaggaaggtcttcctgttgaaacaattgaagaagactaaccaacttctttactctagagttgtccagttttgtatatctgtccatttcagttagttgcatttagagatttggcttttcagagagtgttttgaggtttgtaaaacttcagactttaccatgaaatccagcaaactcgaccggaatccagagaaaaggaacttgattg

SEQ ID NO: 459 - DNA, 1217 bp, Arabidopsis thaliana
acaagaccacaagaaggccaaagagaggctaaactaaaagagctctctttctaatttatttctctctcttctcttctcccgaaaagcccttaataagcttttgctttgatatcagatctctcttacggcttttgagatgcgtgctcctttagggctttccttttataccccaaaacgaggcctttccttcttctctcatctcctaattctaccctcttcctcttcctcttccttctctctctcttctcattctcctcatacgctataaggagaaaatctcagagagagagtgatggcgaacaatgagggagagatgcaatgtgggtccatgttgtttaagcaagaggagctacaagagatgagtggggtcaatgttggtggcgattacgttgaggtcatgtgtggttgtaccagtcaccgatacggcgatgctgttgctagacttagggttttccccaccggtgaccttgaaatcacctgcgaatgcacacctggttgcgatgaagacaagttgacaccagctgcattcgagaagcattctggaagagaaacggcaaggaagtggaaaaacaatgtgtgggttatcattgggggcgaaaaggttccattgtcaaagacagtattgctcaagtactacaatgaatcatcaaagaagtgcagtagatcaaacagatcacaaggtgccaaagtttgccatagagatgagtttgttgggtgtaacgattgtggtaaagagaggaggttcaggctgaggagcagagacgaatgccgcttgcaccacaatgcaatgggtgatccaaactggaaatgctcagatttcccatacgacaagataacatgtgaggaggaagaagagagagggagcaggaaggtgtacagagggtgcacacgttcacctagttgcaaaggctgcacttcctgcgtctgttttggctgcgagttatgccgtttctctgagtgtacttgccagacttgtgtcgacttcaccagcaatgtcaaagcttgaagaaggcagtccattaagaaaagaaaaaaaaatgtctgtctcagactttgttcgttgcatttaataacttattctaaaactccaaacagttaattatcttatctatgggttgtgaatggagcaattgaaaaaaaagtagaaaaagttgatttccaagaagaacatgcagacgagcatgcctgagtttagtgcatgtctagatttttggcta

SEQ ID NO: 460 - DNA, 1211 bp, Arabidopsis thaliana
agaagttgaagacgacgatgacgcttttagctctctcttcttctctgtcttctccttccttcttctgccgcaattctcgtattcgtttctctcctgtgtcgcgtatttcttctcttaatggtgataataagcttacaaattctccgccacagtttttaaatgccggcgcgagtctccgtcgttttgtggctccggggaagtttccaagtgtgagacttagggttttgacgaggtgcgagaaagaaaatgcacccaaaggtgggattgaagatgacgcggagcgatttgcgagacgagagagcacgatgcctgatagattcagatatttgaccaaagaagctccagatagtccaattatatggccatggtttgttgcgctggggtttctcgtttatgcgtggagagctgttttgtttgagctatccaactggagaaaagcggctttcgctatccttgcgtttgtgggagacctttcgaagtttgcattggctcttgtcttccactttataggcgatcccatcacttctctcatcagccttgtagagactgcaatgtacagtgttagggcgttctactccgggattgtggcttacacgcctgtgagagagttaaccacggtaattcttcttgcatcctcagtgcttgctataggagaagcagttgcaccagagtcaatcagcaagcagccgtatgtggtaactattgcgggtctggtggggtatgcagcggtgcagagttatatctcagagccgttcttctggactgtcttgttaggtttgtatgggtactcgcggttgataaagaagagagacgatgtgacctcggctcttccttctgcagctgttctggcaggagtaggggagccatgggtgagagtggtggctatcacagggtatctggctctagccatgtatcacaattcaacgaagacctcctcagaagaagagagtcagatcttaaggagggcaccaccaatgccgttgttggctgcagcattagccattggcgtccgacttgctgcaaaatgggctggatacagacacttgacttggatgattgtttgattctctgctgaaacaaagaactttagagacgaacaaaactagtttgtgttgtaacttgttgtacctttccccaatgtttgaagagaaatttttgatgatacaagaaaaaggttttgtttctctgtttggataatgttagttaatacg

SEQ ID NO: 461 - DNA, 815 bp, Arabidopsis thaliana
acgattctcccgccaccacaccacagctttttgcttcatctccttcttactctctgtgtctctaactcctcgtgcactcagacatcacagatatggcttgtgttcggtcgattggttctttaacttctgtcaaccattctcaacgaaatgttcctcgctcaggcattgtcttatcttcatgctctgttcttcccatcaaaagctcatctttcactggatcccctgtttctctcccgcgggctcaaccatcatcccgaacagctctaagaccgatgaaacccgtctctatcacgatgatggtaaagccggcgctccaattcatccaagggacggatgagatgacaatccctgatgttaagctgactcgatcaagagacggaagcaacggaatggcactgttctctttcgaccaaccatccgttttcgactcgagcggtgaagtcggagagattacaggattgtacatgattgatgaggaaggtgtgattcagtcgacggatgtgaacgcgagattcgtgaatgggaaaccggaagggattgtggcgaagcacataatgcgatcgccgaaagaatgggacaggttcatgaggtttatggagcgatactcggaccagaatggcttgcagtttgttaagaagcaatgaggttggagagaattttcaatgagcaaaacaaaatgtgtatgttacattaaattttttcactcttttgatttataatcttgtactctcctagttttgatctttacttgagtttcaacttacaatggtaatctaggcttttgttctgattaaatttggtttaatctaaacaaa

SEQ ID NO: 462 - DNA, 1754 bp, Arabidopsis thaliana
atccgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaagagtccatggttgagcatcttgatcatcccgacttcccctgaattcgcctactttgtcaaaaatgtgttgtgtgtgtgtgtgtgttgttcctctctctctgcctccctcgtatgaaaatggtaacatttacaattggaaagtcggtgttagcctttagctattagctgaagagctagttttcttgttgcccaggccattctttaccctatttttcatctgaagtaacaatgaaacaaaatctatatatactcgagttttgctttctagg

SEQ ID NO: 463 - DNA, 1176 bp, Arabidopsis thaliana
tttcaaatttgggtcttttgcttcttcttgctcacttgaggaaacacagtaaaaacctaaaaagagaatgaaactcgcaggtctgaaatcgatcgagaacgctcacgaagattccgtttgggcagcgacgtgggttccggcgacggaagatcgaccggcgttgcttctgactggatctcttgacgagacggtgaagttatggcgaccggacgagctggatcttgtgcggactaatactggacactctttgggagtagcagctttggctgcgcatccttctgggattattgcagcatcttcttcgattgatagctttgtccgtgtgtttgatgttgatactaatgctacgattgctgttttggaagctcctccttctgaggtttggggaatgcaatttgaacctaagggtacgatccttgctgttgcaggtggaagtagtgcctcagtcaagctttgggacactgcaagctggagattaatctcaactctatcaatcccacgcccagatgcaccaaaaccttccgataaaaccagcagcaagaaattcgttctctcggtggcttggtctcctaatgggaaacgacttgcttgtggttcaatggatggtacgatctgtgtttttgatgttgaccgctcaaagctacttcaccagctagaaggtcacaatatgcctgtaaggtcccttgtgttctcccctgtagacccgagagtcctcttctctggatcagatgatgggcatgtgaacatgcacgatgcagaagggaaaacgctgttggggtccatgtcagggcacacgagttgggtgctgagcgttgatgctagcccagacggtggagccatagcaaccggctcaagcgatagaactgtgaggctatgggatcttaaaatgagagctgcgattcagacaatgagcaaccacaatgaccaggtttggtctgtggcctttagaccaccaggtggaaccggtgtccgggctggtcgacttgctagtgtctctgatgacaagagtgtatcgctctatgattactcatgaacaattcggttttttgacttttttcttttatgcattctccaagacgcatctagttgtaacaatataatctgcaacaggttgattttgaccggagtctttagatttatcgcttacacaaaaaacaaagaagataaaatgattca

SEQ ID NO: 464 - DNA, 1771 bp, Arabidopsis thaliana
aagtccaatttgctgaagaaggtgaagaggtgagggctcttcacagccattcaatctcataagacatattgccggagaaactctctcggggggtcgcttcttctgcattttctgcttcccaatggcttccagaattgctgattctctcttcgccttcacgggcccacagcaatgtcttcctagggttcctaagcttgctgcttcttctgctcgtgtttctcctggtgtatatgctgtgaagccgattgatcttctgttaaaaggacgaactcatcgaagtagaagatgtgtagctcctgtgaaaaggagaattggatgtatcaaagcggtggctgctccagttgcaccgccttcagctgacagtgcagaagacagggaacagttagcagaaagctatggattcagacaaattggagaagatcttcctgagaatgtcaccttaaaagatatcatggatacacttcccaaagaggtgtttgagattgatgatctgaaagctttgaagtctgtgttgatatctgtgacttcatacactttggggctcttcatgattgcaaaatcgccgtggtatctgctaccgttggcttgggcatggacaggaactgcaattaccgggttctttgtgataggtcatgattgtgcacataagtcattttcaaagaacaaattggtggaagacattgtgggtactctcgccttcctaccacttgtctacccatatgagccatggcggtttaagcacgaccgccatcacgccaaaaccaacatgttagttcatgacacagcttggcagccagttccgccagaggagtttgagtcatcacccgtgatgagaaaggcaatcatttttggatatggcccaattagaccttggttgtccatagctcactgggtgaactggcacttcaatctgaaaaagttcagagcgagcgaggtgaatagggtgaagataagtttggcttgtgttttcgccttcatggccgttgggtggccactgatcgtatacaaagttggtatattgggatgggtaaaattctggttaatgccatggttgggctatcacttctggatgagcacattcacaatggttcatcatacggctccgcatatacctttcaagcctgcggatgagtggaacgcggctcaggcccagctgaatggaactgttcattgtgactaccctagttggattgaaattctctgccatgatatcaacgttcacatcccgcatcatattagcccaagaataccgagctacaatctccgtgcagctcatgagtctatacaagagaactggggaaagtatacaaacttggctacatggaactggcgattgatgaagacgataatgactgtgtgtcatgtctatgacaaagaggagaactacattccttttgaccggttagcccctgaagaatctcagccaataaccttcctcaagaaagcaatgcctaactacacagcctgattcgccatggtctcaaactagtcttttgaaatctcaatatctttttgcagtcgccgatgttatatgtaagctttccaagcgatgagcttctctaacacttcaccaacgctttatactgttatcttctttccaatcttatcagaagagagaaactggtcaaattatctcagcgattgcaattcttttatcagtttcttagctataagaagattgaacagtctatatagtttgcaatgtactgtaatgtgatgaaaatttagttgatgagaatctttgaagatataaacatcatcttcttactgt

SEQ ID NO: 465 - DNA, 1745 bp, Arabidopsis thaliana
atccgaacacaaagacttaagtaagtcaaacagaaaaaaatggatctcttattgattatagccggtttagtagcggctgcagccttctttttcctccgtagcacgaccaagaaatctctccggttacctccgggaccaaaaggtcttcctattataggaaaccttcaccagatggagaaattcaacccccaacacttccttttccgtctctccaagctatacggcccgattttcacgatgaaaatcggtggccgtcgcctcgcggtgatctcctcggccgagctagccaaggagctactcaaaactcaagacctcaacttcaccgctcgtcctctcttgaaagggcaacaaaccatgtcgtatcaaggccgtgagcttggtttcggacagtacaccgcgtactaccgtgagatgaggaagatgtgtatggtgaacctcttcagcccgaaccgtgtcgcaagtttcagaccggttagagaagaagagtgtcaacggatgatggacaagatctataaagccgctgatcaatcaggcaccgttgatctaagtgagcttctcttgtctttcactaactgtgtcgtatgtagacaagcttttgggaaacggtacaatgagtacggcacagagatgaagagattcatagatatcttgtacgagacgcaagcacttttgggcactctgtttttctccgaccttttcccttatttcggattccttgacaacctcactggtctcagtgcacgtctcaagaaagctttcaaggagcttgacacttaccttcaagaacttctagacgagactcttgaccctaaccgccctaaacaagaaacagagagtttcattgatcttttgatgcagatctacaaagaccaacctttctccatcaaattcactcacgaaaatgtcaaggccatgatattggatattgttgtgccgggaactgacacggcggctgcagtggtggtatgggccatgacttaccttattaagtaccctgaagcaatgaagaaagctcaagacgaagtgaggagtgtgataggtgacaaaggatatgtctctgaagaagacatacctaatctcccttacctaaaggcagtcatcaaggagtctcttcggctcgaaccagtcatccccattcttctacacagagaaactatcgcagacgcaaagataggtggctatgatattccggccaagaccatcattcaggtgaacgcatgggcggtttctcgtgacacagccgcgtggggagacaaccctaatgagttcattccagagaggttcatgaacgagcacaaaggagtggacttcaagggccaagattttgagctcctacctttcgggtcgggccggagaatgtgcccggccatgcatcttgggattgcaatggtagagatacctttcgctaaccttctctacaaatttgactggagtctacctaaagggattaaaccagaggatataaagatggacgtcatgactggactcgctatgcacaagaaagaacacctcgttcttgcaccaacgaaacacatctgatgctatatatatcattaggacgtttctgctggtagatatggcgtgaccaatggttatttttcattgcaatatccctttttgttttaatgagtactatgttctcattttaacgaataaaaatgtatcagtgctcttgtttttggactagaaaagaaagtagtccgatgtttaatattcgggtccctttaatattccctctggtttac

SEQ ID NO: 466 - DNA, 2019 bp, Arabidopsis thaliana
attcactaaaacttcatttactttcttgaacttgtcttgtgccctctttccaatacactgaaatccacttcaaaatatttatttaataaaaagaaaagaaaagaaaaaaactctgccaggatggcttctttgatcacaaccaaagcaatgatgagtcatcatcatgttttgtcgtcaactagaatcactactctttattccgacaattccatcggcgatcaacaaataaaaacaaaacctcaagtccctcaccggttatttgctcggaggatcttcggtgtaaccagagctgtaattaattcagcggcaccgtctccgttgccggagaaagagaaggtggaaggtgagagacggtgtcatgttgcgtggacaagtgtacaacaagagaattgggagggtgaacttactgtccaaggaaagatacccacttggctgaatggtacgtacctaagaaacggtcctggtctatggaacattggagaccacgatttccggcatctcttcgacggctactccacactcgtcaagcttcaattcgatggcggtcgtatattcgccgcccaccgtctccttgaatccgacgcttacaaagccgccaagaaacacaataggctttgttaccgtgaattctccgagactccaaaatcggtgatcataaacaaaaaccctttctccgggatcggagaaatcgtcaggcttttctccggagagtctttaacggacaacgccaacaccggagtgatcaaactcggtgacgggcgggtcatgtgtctgacggagactcaaaaaggatcgattttagtcgaccatgagacgctagagacgatcgggaaatttgagtacgacgacgtattgtccgatcatatgatccaatcagcgcatccgatagtgacggagacggagatgtggacgttgataccggatttggttaaaccgggttatcgggtcgtgaggatggaagccgggtcgaataaaagagaggttgtggggcgggtgaggtgtcgaagtgggtcgtggggacccggttgggtccattcgtttgcggtgacggagaattatgttgtaataccggaaatgcccctgagatattcggtgaagaatcttcttagagctgagccgacgccactttacaagttcgagtggtgtccccaagacggagcttttattcatgtcatgtccaaactcaccggagaagtcgtggctagcgtggaggttccagcatacgtaacgtttcacttcataaacgcgtatgaagaagataaaaatggcgatggaaaagcgacggtcatcattgcagattgttgtgaacacaacgccgatactcggatactcgatatgctccgtctcgataccctacgttcttcccatggtcacgacgttttacccgatgctaggatcgggagattcaggataccattggacgggagcaaatacgggaaactagagacagccgtggaggcagagaagcatgggagagcgatggatatgtgcagcatcaatcctttgtatttgggtcaaaaataccgttacgtttatgcatgcggtgctcaacgaccttgtaacttccccaatgctctctccaaggttgatattgtggagaagaaagtgaagaactggcacgagcatggtatgataccatctgaaccattcttcgtgcctcgacccggtgcaacccatgaggatgatggagtggtgatatcgatagtaagtgaagaaaatggaggaagctttgcaatcttgcttgatgggagctcctttgaagaaatagcaagagccaagtttccctatggccttccttatggcttgcatggttgctggatccccaaagattaactacaaagtctcaacaaagataccttcattatacaaaacacaacatatgtataattaataccctctgtgcaggttttgtaaattgttgtcccttatatatgctttttgtctatatatgtgatgtacaaaaccaaaataaaaggaacggattgtggtggatacagttattaaaaattgcactagacc

SEQ ID NO: 467 - DNA, 1707 bp, Arabidopsis thaliana
cagttgtactctgttgcattatttctctcactcaaacgtatatacaaacataaattatgtcgacagaaatggaggtcgttagtgttcttaagtaccttgacaacaaatccatattggtcgttggaagctgctgggttcttagcaaatatctttgtggagaagatattaagggtggcaccaaacgtgaagaaactctatctccttctaagagcatcaaaaggaaaatctgctacccagaggtttaacgacgagattttgaagaaagatttgttcaaggtgctgaaggagaagtatggtcccaatctaaatcaacttacatcagagaaaatcactattgtcgacggagacatttgccttgaggatttaggtcttcaagacttcgacttggctcatgagatgatccaccaagttgatgccattgttaatttagctgcaactactaagtttgatgaaagatacgatgtagctcttgggatcaacacattgggtgctctcaatgtcttgaactttgccaagagatgtgcaaaggttaagatccttgttcatgtatcaacagcttacgtgtgcggagaaaaatctggcttgataatggaaacaccgtaccgtatgggtgagacgttgaatggaaccaccggtttagacatcaactacgagaaaaaattggttcaggagaaacttgaccagctccgagtaatcggagccgctcctgaaaccatcacggaaaccatgaaggatctcggactcagacgggcaaagatgtacggatggccaaacacatatgtgttcaccaaagcaatgggggagatgatggtagggacaaaaagagaaaatctgtcacttgtgttgcttcgtccttcaattattaccagcacattcaaagaaccatttcctggttggactgagggcatcaggactattgatagtttagctgttggatatggcaaaggcaaactcacgtgcttcctctgtgatcttgatgctgtttctgatgtgatgccggcagatatggtagtaaattcgattcttgtatcaatggccgctcaagccggtaaacaagaagagattatttaccatgtgggttcttcacttagaaatccgatgaaaaattcaaagtttcctgaattagcgtatcggtatttctcaatcaaaccgtggaccaacaaagaagggaaggtcgttaaggtcggggccattgagatcctgagttctatgcgtagtttccatagatacatgaccatacgctacttgattgcattgaagggacttgaattggtaaacataatactttgcaagttgtttgagaaggaatttcagtatttcaataagaaaataaattttatattccggcttgttgatctctatcagccttacctctttttctatggaatatttgatgattcaaacacagaaaaattgcgaaaaatggtatcgaagacgggagtcgaaaacgagatgttttatttcgatccaaaggttctcgattgggacgactattttttgaacacacatgttattgggctgcttaagtatgtcttctaataattttagttgtataatctttatcttattttactacaacgagtataaattatgtggacactatcgttctccttaatccgttttcatacggctatgtttcgaaatttggttatagacttgggctgtttatctctataatgaaactatatattggatgtaattttcttc

SEQ ID NO: 468 - DNA, 650 bp, Arabidopsis thaliana
ccaaaacccaccagcttaaataaaaacctttacttatcttctttcttctcacttctcagacctcaatttccaagcagagatgacggtgaagataaggctcgcgcgtcttggttgtaaacaccgacccttctatcgtgtagttgtcgccgatgaaaaatcgcgcagggacggtaaacaaatcgaggtgttaggcttttatgatccactccaaggcaaagaagatgcggatagagtgagcctcaaattcgacagaatcaagtactggttatctgttggagctcaaccaacagacacagtggaaagcatgcttttcagggccggtttgataccaccaaagcctatggtagtggtcggttcgaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgttggttaagacttttctgcaacagagtttggtgaatttttattctttaatatgagcatgcctttttacatttaaca

SEQ ID NO: 469 - DNA, 1348 bp, Arabidopsis thaliana
attccagaaatgaccggctaaagtcaagaacctctctctgagctctcaccactttctctctctactccctctctgcgtgtaggatactactagacaattgacaaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggaatgcttatacaaacgagttagaacttgaagttgctcacttgcaggcagaaaatgcaagactcaagagacaacaagatcagttaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtactaacttctacttgtattcttgttgtagtaatgttctacttcctcttctaatactagt

SEQ ID NO: 470 - DNA, 1642 bp, Arabidopsis thaliana
cattaaagtttttattttattttctaccaaccaaaagcttttctctttggtttctcttatttagcttctaaccttgaggagaatcataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgaatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatttgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 471 - DNA, 1068 bp, Arabidopsis thaliana
atagccacataaaaaatggcgatgatattttgcaacactctctactcttcttcttctccatcatatctctcgccgttaacttcaaaaccgtcgcgattctcaaagaatctcagacctcgagctcaattccagtccatggaagaccacgacgatcacctccgccgaaaatttatggagttcccgtatgtgtcacccacgcggaagcagctcatggttgatctcatgtcgacggtggagaatcgcctccaatcacaactccttccctgtaacctccctccagatgtacgaaacttcaataaccctaacggttccgccgaagcatctcttcatatcagatccggcgacaaatcttctccgattgattttgttataggaagttggatacattgcaagatcccaacaggagtatctttgaatataacaagcatctctggattcttaaactcatcaacaaaagctccaaactttgtggtcgaactaatacagagcagttccaagtcgcttgtgctaatccttgacctcccacatcgtaaagatcttgttcttaacccggattatctcaaggagtattaccaagacactgctcttgattctcatcgacaatctctccttaagctacctgaagttaacccttatgtgtctccttctctctttgtccgttctgctttctctcctactgcttcgatgcttaagattgatgcggaggaagaggataagttggaggagatattgagagatcatgttagtccagctgctaaggaggttctcgaggtttggttggagcggtgtgtgaaggaagaagaagagaagattgtggttggggaagaagagagaatggagttggagagaagagataaaagctttagaaggaagagcatagaggacgatttggatttgcagtttccgagaatgtttggtgaagaagtttcctcccgtgttgtacacgctattaaagaagctttcggtgttctctagattatgtaactatatatatacatcagttaatgttcattgtactaaacatttactttcatcaatgtcacaagaacgcaagatgaccatcaaaca

SEQ ID NO: 472 - DNA, 432 bp, Arabidopsis thaliana
atgactagccttacctacacactcgatgaaatcgaaggccctttcgaagttgattacgcagcagtgacagtacacaacttcctggtggggagcgtgtaccgttcttgttcacgatcaagcagctcgtggcatcgcagaggatactttggtcccaagtcgatcccttcagcattcacccaaggccacgttggaaataaatctgatcaatatcaaggctatgacaatgcggttgcattacctgctagaggaaacaatgaggagctagctaaggagaacaacaagatcacacttagtgtaacaaagagtaatcccgagagcggtgaagtgattggtgctttcgagagtattcaaccttcagacactgatttgggtgctacgactcctaaggatgtcaagattcaaggaatctggtattgccaacttgatgaataa

SEQ ID NO: 473 - DNA, 1846 bp, Arabidopsis thaliana
ctccaacttttaaaactcatcataaatagtaaaaaagtagccggaaaaataaaataaaaagtctatttctctttcctttaaaatccaaatcctataaactcatagctttctctgttctttacttatacctcacgttatacatatatatagagtttctataaatgcttctctttcctctcgaacaaatcttcctcacttctctcatttccacactcaccttcctctctatatattaaaccctatctacttaactcttcttctaactctaatctctctctctatttactctgcttctgttctcactctgaaagaaccaaaacatgacggtggttagagagtacgacccgacccgagacttagtcggcgtggaggacgtggaacgacggtgtgaagtcggaccaagcggcaagctttctcttttcaccgaccttttgggtgacccgatttgtagaatccgacattcaccttcctatctcatgctggtggctgagatgggtacggagaagaaggagatagtgggcatgattagaggatgtatcaaaaccgttacatgtggccaaaaactcgatttaaatcacaaatctcaaaacgatgtcgttaagcctctttacactaaactcgcttacgtcttgggccttcgcgtctctccttttcacaggagacaagggattgggtttaagctcgtgaagatgatggaggaatggtttagacaaaacggagctgagtattcgtatattgcaactgagaacgataatcaagcttctgtgaatttgttcaccgggaaatgtggttattcggagtttcgtacaccgtcgattttggttaacccggtttacgctcatcgagttaatgtttcgcggcgagtcacggttatcaagttagagccggttgatgctgagacgttgtaccgaatccggtttagcacaacagagtttttcccgcgggatattgattcggtacttaataacaaactctcgcttgggactttcgtcgcggtgccacgtggaagctgttatggatccgggtctggatcatggcccggttcggctaaattcctcgaatatccacccgagtcatgggccgtattaagcgtgtggaattgtaaagactcgtttctgttagaagtacgtggagcgtcgagattgagacgtgtggtggctaaaacgacgcgagtagttgataaaacgttgccgtttctgaaactaccttcgataccgtccgttttcgaaccttttggacttcattttatgtatggaatcggaggagaaggtccacgcgcggtgaagatggtgaaatccttgtgtgctcacgcgcataacttggctaaggcaggtggttgtggtgtcgtggcggcggaagttgccggagaagacccgttgcggcgaggaataccacattggaaagtgctatcgtgtgacgaggatctttggtgtataaagcggcttggagatgactatagtgatggtgttgttggtgattggactaaatcgccacctggcgtttccatttttgtagaccctagagaattttaaaactttttttttaactctataatatatattctctattaaccacttgatgttaaattaggggttttcttctaagtttatagattttcttgttttagaattaatctttttttttaggtaactttttttgctttttgttttgttttgttttgtttttgtgggtgttataaattagtggtaagaggtaatatctcctacttttgggtttgtgtcttcttgtcttgtaaatggatctagctttttaagatactttttctttgtggccaaaccaaaacgccgacctgattattatttccaagtagataaaatttcatgaa

SEQ ID NO: 474 - DNA, 1925 bp, Arabidopsis thaliana
gttcttctccctctgtctctctcttctctcatctttagctatcttcctcccatggcaactatctctcaagtcattatctaactttttttccttctttttctttttatattacttacttcttatggatattggtgttcatgttcttgggtcggttactagtaatgaaaatgagtcacttggtctaaaagagcttataggaactaaacaagatagatccggattcatcggtgaggattgcttgcaacgaagcttgaagctagcaagaacgacaactagagcggaagaagaagaaaacttgtcttcttctgttgcagctgcttattgcaaaacgatgtcgtttcaccaaggcattcctctcatgagatctgcttctcctctttcctctgattctcgccgtcaagaacaaatgcttagcttctcagataaaccagacgctcttgatttcagtaaatatgtcggtttggataatagcagtaataacaagaactctctctcgccgtttcttcaccagattcctccaccttcttactttagaagctcaggaggatatggttctggtggaatgatgatgaacatgagcatgcaagggaacttcacaggtgttaaaggaccttttacattgactcaatgggctgagttagagcaacaggcgttgatctataagtacatcacagccaatgtccctgttccttctagtttgctcatctctatcaagaagtctttttatccttacggatctttgcctcctagttccttcggatggggaactttccatctcggtttcgcaggcggtaacatggaccctgagccagggagatgccgcagaacagatgggaagaaatggcggtgctcaagagacgccgttcctgatcagaaatactgtgaaagacacatcaacagaggccgtcatcgttcaagaaagcctgtggaagtccaatctggccaaaaccaaaccgccgctgctgcatccaaagcggttactacaccacaacagcctgttgtcgctggtaatactaacagaagcaatgcccgtgcatcaagcaaccgcagcctcgccattggaagtcaatatatcaatccttctacagaatctttacctaacaacagaggagtttcgatatatccttccaccgtcaacttacaacccaaggaatctccggttattcatcagaaacacagaaacaacaacaacccttttgagtttggacacatatcctctgattcgttactcaacccgaataccgcaaagacctatggatcatcgttcttggatttcagcagcaaccaagagaagcattcagggaatcacaatcacaattcttggcctgaagagctgacatcagattggacacagctctcaatgtcaattccaatagcatcatcatccccttcctccacacacaacaacaacaatgctcaagaaaaaacaacactctcgcctctcaggctatcccgcgagcttgacctatcgatccaaaccgatgaaacaacaatcgagcctactgtgaaaaaggtgaatacttggataccaatctcatggggaaactccttaggaggtcctctaggtgaagtactaaacagtacaacgaatagtccaacatttggatcttctcctacaggggttttgcaaaagtccacattttgttcactctctaacaacagctccgtgagcagccccattgcagagaacaacagacacaatggcgattactttcattacacaacctgaaaactgaaaccaagtcctgcggcaggaaacaaaaaaagaaaagctctgttttttctctttcattatgttctgtttcgtctttctaaagcttaaagaggaaattagaaaatcgttgttcttctgattctttcttcgtttccgatttctgaatcatttgtttgataatcacttcatataatcacaatctttattctaa

SEQ ID NO: 475 - DNA, 1194 bp, Arabidopsis thaliana
aatcatacgctcctgagatcctcatgacttgttcttaccgtactccgcgagacatgcgattgatgattcttgactgtattcattgagaaaaactgttcgcaaaaaccttgagcttcatcatcgtccattactcacctttcagtttcagatgcccaagcaaaaagctccaaggaagcagctcaagtcctataaactcaaacacatcaacaagagtattcaagagggagatgctgtgttgatgcggtcgtcggagcctggaaaaccgtcgtacgtagcgagggtagaggcgatcgagacggacgcgcgtggatcgcacgcgaaagttcgtgtgaggtggtattatcgccctgaggaatctatcggagggaggagacaattccatggagccaaggaggtttttctctctgaccacttcgattttcaaagcgccgatacgattgaaggaaagtgtaaggttcacagtttcagtagctacaccaaacttgactctgttggaaacgacgacttcttctgtcgtttcgagtacaattccactaccggcgcgtttgatcctgacagagtcaccgtgttctgcaagtgtgagatgccgtataacccagatgacttgatggtgcaatgcgaggagtgttctgagtggtttcatccttcttgtataggaacaacaatagaggaagctaaaaagccagataacttctactgcgaagagtgttccccacaacagcagaatttgcacaactctaattcaacttccaataacagagatgctaaggtgaatggaaagcgcagcctggaggtaactaaatcgaagaacaaacacactaagcgaccaggttaacataaacttgtaaaggctatagatatctggttggtgagtctgagtatcaatcgtgtaatctacaaaggtggttttgttttctttccctctctagttttttctttcttaaaaaatgagggtttaggtttgttggcttgattgttgtataatttatatgtatagcgtatggtggtttctcatctcctttagttgtcacatataaaatttgggtaaaatggtttgtttataataagaaaacaaaacaaacaaacaaacaaagagagtgttggttccttatttgtttgttttcattgtgaactctagaaacccttcattctttattagtttttcattctttattaattctaaaacgcatattc

SEQ ID NO: 476 - DNA, 1692 bp, Arabidopsis thaliana
atggactacttgttgacatcaccttcgtcactgagattctccgatttcatctcttcgattcccaaagaaaccgatcacaaatggcttcgcttctcagtaaatctcggcgatgcgaggaggtcgacgaggacgaggataacttgcggtgcgatttcgtcaaggaggaaacttgctgagagagagagtgcggagagagaaaatagagtgctggttcggagtcttatgtcgaggattagtgacagagagccattggtgaagacgcttgataagtacgtgaaggtcgtaagatgtgaccattgtttcttactctttgaagagcttggtaaaagcgataaatggctacaatgtctcgaggtgttcaggtggatgcagaaacagcggtggtatatcccagataatggagtctactcgaaattgatatctgtaatggggaaaaagggtcagacccgtatggcaatgtggttgttttccgagatgaaaaacagtgggtgtcgtcctgatgcttctgtttacaacgctctcataacggctcatcttcatacacgagacaaggcaaaagctttagagaaagttcgtggatacttggacaaaatgaaagggattgagcggtgtcaacccaatgttgtgacttataatatcctgttgagggcttttgctcaatctggtaaagtggaccaagtcaatgctttgtttaaggacttggatatgagtccagtttctccagacgtctacaccttcaacggtgttatggatgcgtatgggaaaaacgggatgattaaggagatggaagctgtgcttactcgtatgaggagtaacgagtgtaagccagacatcatcacctttaatgtgcttattgactcgtatggtaagaagcaagagtttgagaagatggagcagactttcaagagtttaatgcggtccaaggagaagccaactctgcctacattcaattcaatgattataaattacgggaaagctcgtatgatagataaggcggaatgggttttcaaaaagatgaatgatatgaactacataccaagttttatcacatatgagtgcatgatcatgatgtacggttactgtggctctgtttccagagctagggaaatatttgaggaggttggtgaatctgatagggtgttgaaggcgtcaacacttaatgccatgcttgaagtttactgtcgtaatggtctatacattgaagcagataagcttttccataacgcaagtgcttttcgggttcatccagatgcatcgacgtataagtttctatataaggcatataccaaggcagatatgaaggagcaggtccagatactgatgaagaaaatggagaaagatggaattgtacctaataagaggttcttcttggaagcccttgaagttttcgggtcaagactacctggttctggttctgaaaacaggaaatcaactcgttccagcaggtcacgagacagccctaaaggacgtggtggaaaccaattgactgaattccaagataaagataataagcatgttttcagagctgttcaagattgcagaaagaactatttggagaacttgagtggacatgataaaggttccagggatgaatcaagaaagcctagtcaagaaaagcagccactatttgcttcagatcaaaataatatgatgatcaaagagaagaaagaactattcactagagtcttgtaa

SEQ ID NO: 477 - DNA, 1222 bp, Arabidopsis thaliana
tggatttgtgaatcgatccaacggtcataatcgtctttccaagataggccagctccgaaactcacctccacgcatctataatcgtgtatcaagaaacggatctttcttctctatcttctgaatatcacaaaacccaattagccggagatggccgcaacatccgccgctgctgcagctgcttcttccatcatgggtactcgggtggctcccggtatccatcccggttcaggtcggttcacagccgtgttcggtttcggaaagaagaaggcagctcccaaaaagagtgccaaaaagacggtgactacggaccggcctctttggtacccaggcgccatttctcctgactggcttgatggttccttggttggagattacggttttgatcccttcggtttaggcaaaccggccgagtatcttcaattcgatatcgattcactagaccagaatctggctaagaacttggccggagacgtgatcggaacccgtacggaagctgccgacgccaaatcgacgccgtttcagccgtacagtgaggtgttcggaatccagagattcagggaatgcgaactcatccacggacggtgggcgatgctcgctactctcggcgctctctccgtcgaatggcttaccggcgttacatggcaagacgctggcaaggtggagcttgtagatggatcgtcctacttggggcagccattacctttctcgatctcgacattgatatggatcgaggtgttagtgatcggctacatcgagttccagcgcaacgccgagcttgattcggagaagcgtttataccccggaggcaagttctttgacccgctaggtttagcggctgacccggagaagactgctcaacttcagttagctgagatcaagcatgcacgtcttgcgatggtcgccttcttgggattcgcggttcaagcggctgcaacaggtaaaggtccactcaacaattgggctactcacctcagtgatccactccacaccaccatcatcgataccttctcctcatcttaaaatcattatcatgtgagattctatttgtaacttatgtaaaaacagagctatgatgatactgaatcgactttgggcttttgcttgtttggtttatttacatgtttggcccatgacattaaattgggcttctccttatttactatacctactcgtcgtacattttcaaaatgtatttttgtcgcatatacagattggcccaata

SEQ ID NO: 478 - DNA, 2911 bp, Arabidopsis thaliana
atagaatttctcgtttttatcacccgcttcatttgcctttctatcgccacaagaacacagagagagaacgattagcccagttccgatatcgttcggtggcttcttcatctgaagctacgatgatgtcggtgagagcaatcaatggttgctccatcattcgcaccgccacttccgccggcggtcctcccgtctctctattccgccaccgtattcagcgcctcagagcttctcatctccgtgaattctcgaaattacgtttaaattttccactaatccgcgcggataggcggtttctcggaaatagtgatgctccgagctgttcgacttgcatacatagtctggtcgaaagtgtttccgaagagctcgaatccatcagcagacgcaagggaagccgaatgagagttcgcgccagtgtaaaggtgaaattaacaagctacggagaggttctagaggataagctagtaaaccaggagctagaggctggtttgcttctggagtttaagaaggacgcagacagagtgttgttggcagttcttcatagacgtgatggcaagaagaattggatggtgtttgatcagaatggtgttagttgttccatcaaaccacagcaaattacatacatcgtcccgaatgtttataattttgatcatacaggacttactgattttctccaaagggctcaagataacttggatccccaactgcttgagtttgcttggatggagttacttgagaagaacaaacctgtgaccccagaagagttagcagagatgatatatggtcgcgcagatcctcttgaaagctattgtgctcattttttgctatcacaagacgagatatacttttctatcttggagtcaaaaggttctcgatcaatatatagccctcggcctactgaacaggtggaagagcttttacgaaggcaacgcgtgaaggaggcagaagataaagagtttcaggagtttattcaattgctgaagtctgccaagaaggcacctagtcacgccaagccccctaaatcttcatggctagctgatgataaagtccaagataggattggctcacttgaagcttatgccattgatgcatgggcaagcactgaccagcagaaattggctggaacgatattaaaatccatggggttacagaaaacgtctgtatcagcactaaaccttctcatagatattggatattttcctgtacatgtcaatcttgaactgcttaagctgaatcttccaacccaccactcagaagctatcactgaagctgctgaagctcttctttcagaatcgtctgatattgatgcggttaggaggattgatctcacacacttgaaggtttatgcaattgatgttgatgaggctgatgagcttgatgatgccctcagtgcaacgagattgcaggatggacggataaagatctggatacatgttgctgatcctgctagatatgttacacctgggagtaaagtggacagagaggcaaggagaaggggaacttctgtctttctgccaacggctacttatccaatgtttccagagaaacttgccatggaaggaatgagcttaagacaaggagaaaactgtaatgctgtctctgtgtctgttgtcctgcgttctgatggctgtattacagaatattcagtagataattcaatcatcagaccgacctatatgttgacgtatgaaagtgcttctgagctgcttcacttgaacctagaagaagaagctgaactgaaattgctgtctgaggcagcattcattcgctctcagtggcgccgtgaacagggtgcagtggacacaactacactagaaactcgtatcaaagtggtgaatcctgaggatccagaacctttgataaatctctatgtagaaaatcaggcagatctagcgatgagacttgtctttgaaatgatgattctttgtggggaggttgtagcaacgtttgggtctcagcataatattccattgccatatagaggacagccacagtcaaatattgatgtatctgcatttgcgcatcttccagaaggaccagtacgttcctcatccattgtcaaagtaatgcgtgctgcagaaatgaatttcagatgtcctgttcgacatggagtgcttggaattcctggttacgttcagttcacgtctcccattcgtcgatacatggatcttactgcacactatcagattaaagcttttcttcgaggaggtgacaattttccattctctgctggtgagttagaaggtatagcagcatccgtaaacatgcagagcaaagtggtgagaaaactctcaaacaccggtctccgctattgggtaatagagtttctcagaagacaggaaaagggtaaaaagtacaccgcattggtcttgagatttgtcaaagaccggatcgcatcccttttgttggttgaggtgggttttcaagcaacggcgtgggtgtcagaaggaaaacaagtgggagatgaaatcgaagttcgagtagaagaagctcatccccgcgacgatcttattctcttcaaagaggttatctagagctttaaaaacacacagttcaggaaaattcattaaagtcggtttctctaaacatggagatgcctgaaactgatagaaagcttgtgtttacaaaagagaaacttgctgatggacgcagccattggtggcttgagctatgatctgctataaaagttgaacacatggtaatatggtacgcacttaatagggttcatacaattttacatcatcttgttattctaagtatttatggaaacttgcgtttgttctgtagagcaaaggatgaaaaaggaatgtatatatatactatttcaatgttgaattttattgatctaaagtcttgaacagagctcgaaggccttagaaaaatatcaacttgatataattaagctcttaagatt

SEQ ID NO: 479 - DNA, 6475 bp, Arabidopsis thaliana
cattgactcgcctgagaatcagaaagcttagatcgattcttagttaatgtcgccttctctaaccaagtcagattaaaaaggagtgttcgtccatgttgctttgttttggtgtttggagagagttttcggagagttaggtgagtgttatttggggtgaggtagtgataaggtttgaagggggagtgattcatcaagtgtgttatgaattcgagggctgatccgggggatagatattttcgagttcctttggagaatcaaactcaacaagagttcatgggttcttggattccatttacacccaaaaaacctagatcaagtctgatggtagatgagagagtgataaaccaggatctaaatgggtttccaggtggtgaatttgtagacaggggattctgcaacactggtgtggatcataatggggtttttgatcatggtgctcatcagggcgttaccaacttaagtatgatgatcaatagcttagcgggatcacatgcacaagcttggagtaatagtgagagagatcttttgggcaggagtgaggtgacttctcctttagcaccagttatcagaaacaccaccggtaatgtagagccggtcaatggaaattttacttcagatgtgggtatggtaaatggtcctttcacccagagtggcacttctcaagctggctataatgagtttgaattggatgacttgttgaatcctgatcagatgcccttctccttcacaagcttgctgagtggtggggatagcttattcaaggttcgtcaatatggacctccagcgtgtaacaagcctctttacaatttgaattcaccaattagaagagaagcagttgggtcagtctgtgaaagttcgtttcaatatgtaccgtcaacgcccagtctgttcagaacaggtgaaaagactggattccttgaacagatagttacaactactggacatgaaatcccagagccgaaatctgacaaaagtatgcagagcattatggactcgtctgctgttaatgcgacggaagctactgaacaaaatgatggcagcagacaagatgttctggagttcgaccttaacaaaactcctcagcagaaaccctccaaaaggaaaaggaagttcatgcccaaggtggtcgtggaaggcaaacctaaaagaaagccacgcaaacctgcagaacttcccaaagtggtcgtggaaggcaaacctaaaaggaagccacgcaaagctgcaactcaggaaaaagtgaaatctaaagaaaccgggagtgccaaaaagaaaaatttgaaagaatcagcaactaaaaagccagccaatgttggagatatgagcaacaaaagccctgaagtcacactcaaaagttgcagaaaagctttgaattttgacttggagaatcctggagatgcgaggcaaggtgactctgagtctgaaattgtccagaacagtagtggcgcaaactcgttttctgagatcagagatgccattggtggaactaatggtagtttcctggattcagtgtcacaaatagacaagaccaatggattgggggctatgaaccagccacttgaagtgtcaatgggaaaccagccagataaactatctacaggagcgaaactggccagagaccaacaacctgatttattgactagaaaccagcaatgccagttcccagtggcaacccagaacacccagttcccaatggaaaaccaacaagcttggcttcagatgaaaaaccaacttattggctttccatttggtaaccagcaacctcgcatgaccataagaaaccagcagccttgcttggccatgggtaatcaacaacctatgtatctgataggaactccacggcctgcattagtaagtggaaaccagcaactaggaggtccccaaggaaacaagcggcctatatttttgaatcaccagacttgtttacctgctggaaatcagctatatggatcacctacagacatgcatcaacttgttatgtcaaccggagggcaacaacatggactactgataaaaaaccagcaacctggatcattaataagaggccagcagccttgcgtacctttgattgaccagcaacctgcaactccaaaaggttttactcacttgaatcagatggtagctaccagcatgtcatcgcctgggcttcgacctcattctcagtcacaagttcctacaacatatctacatgtggaatctgtttccaggattttgaatgggactacaggtacatgccagagaagcagggctcctgcatacgattctttacagcaagatatccatcaaggaaataagtacatactttctcatgagatatccaatggtaatgggtgcaagaaagcgttacctcaaaactcttctctgccaactccaattatggctaaacttgaggaagccaggggctcgaagagacagtatcatcgtgcaatgggacagacggaaaagcatgatctaaacttagctcaacagattgctcaatcacaagatgtggagagacataacagcagcacgtgtgtggaatatttagatgctgcaaagaaaacgaaaatccagaaagtagtccaagaaaatttgcatggcatgccacctgaggttatagaaatcgaggatgatccaactgatggggcaagaaaaggtaaaaatactgccagcatcagtaaaggtgcatctaaaggaaactcgtctccagttaaaaagacagcagaaaaggagaaatgtattgtcccaaaaacgcctgcaaaaaagggtcgagcaggtagaaaaaaatcagtacctccgcctgctcatgcctcagagatccagctttggcaacctactcctccaaagacacctttatcaagaagcaagcctaaaggaaaagggagaaagtccatacaagattcaggaaaagcaagaggtccatcaggagaacttctgtgtcaggattctattgcggaaataatttacaggatgcaaaatctgtatctaggagacaaagaaagagaacaagagcaaaatgcaatggtcttgtacaaaggagatggtgcacttgttccctatgagagcaagaagcgaaaaccaagacccaaagttgacattgacgatgaaacaactcgcatatggaacttactgatggggaaaggagatgaaaaagaaggggatgaagagaaggataaaaagaaagagaagtggtgggaagaagaaagaagagtcttccgaggaagggctgattccttcatcgctcgcatgcacctggtacaaggagatagacgtttttcgccatggaagggatcggtggttgattcggtcattggagttttccttacacagaatgtctcggatcacctttcaagctctgcgttcatgtctctagctgctcgattccctccaaaattaagcagcagccgagaagatgaaaggaatgttagaagcgtagttgttgaagatccagaaggatgcattctgaacttaaatgaaattccttcgtggcaggaaaaggttcaacatccatctgacatggaagtttctggggttgatagtggatcaaaagagcagctaagggactgttcaaactctggaattgaaagatttaatttcttagagaagagtattcaaaatttagaagaggaagtattatcatcacaagattcttttgatccggcgatatttcagtcgtgtgggagagttggatcctgttcatgttccaaatcagacgcagagtttcctacaaccaggtgtgaaacaaaaactgtcagtggaacatcacaatcagtgcaaactgggagcccaaacttgtctgatgaaatttgtcttcaagggaatgagagaccgcatctatatgaaggatctggtgatgttcagaaacaagaaactacaaatgtcgctcagaagaaacctgatcttgaaaaaacaatgaattggaaagactctgtctgttttggtcagccaagaaatgatactaattggcaaacaactccttccagcagctatgagcagtgtgcgactcgacagccacatgtactagacatagaggattttggaatgcaaggtgaaggccttggttattcttggatgtccatctcaccaagagttgacagagtaaagaacaaaaatgtaccacgcaggtttttcagacaaggtggaagtgttccaagagaattcacaggtcagatcataccatcaacgcctcatgaattaccaggaatgggattgtccggttcctcaagcgccgtccaagaacaccaggacgatacccaacataatcaacaagatgagatgaataaagcatcccatttacaaaaaacatttttggatctgctcaactcctctgaagaatgccttacaagacagtccagtaccaaacagaacatcacggatggctgtctaccgagagatagaactgctgaagacgtggttgatccgctcagtaacaattcaagcttacagaacatattggtcgaatcaaattccagcaataaagagcagacggcagttgaatacaaggagacaaatgccactattttacgagagatgaaagggacgcttgctgatgggaaaaagcctacaagccagtgggatagtctcagaaaagatgtggaggggaatgaagggagacaggaacgaaacaaaaacaatatggattccatagactatgaagcaataagacgtgctagtatcagcgagatttctgaggctatcaaggaaagagggatgaataacatgttggccgtacgaattaaggatttcctagaacggatagttaaagatcatggtggtatcgaccttgaatggttgagagaatctcctcctgataaagccaaggactatctcttgagcataagaggtctgggtttgaaaagtgttgaatgcgtgcgactcttaacactccacaatcttgctttccctgttgacacgaatgttggaaggatagcagttaggatgggatgggtgcctctacaacccctacctgaatcacttcagttacacctcctggagctatacccagtgctcgagtccatccaaaaatttctttggccaagactttgcaaactcgatcaacgaacactgtatgaattacactaccaactgattacgtttggaaaggtattttgcacaaagagtagaccaaattgtaatgcatgtccaatgagaggagagtgcagacactttgccagtgcttatgctagtgcaagacttgctttaccggcaccagaggagaggagcttaacaagtgcaactattccggtccctcccgagtcctatcctcctgtagccatcccgatgatagaactacctcttccgttggagaaatccctagcaagtggagcaccatcgaatagagaaaactgtgaaccaataattgaagagccggcctcgcccgggcaagagtgcactgaaataaccgagagtgatattgaagatgcttactacaatgaggaccctgacgagatcccaacaataaaactcaacattgaacagtttggaatgactctacgggaacacatggaaagaaacatggagctccaagaaggtgacatgtccaaggctttggttgctttgcatccaacaactacttctattccaactcccaaactaaagaacattagccgtctcaggacagagcaccaagtgtacgagctcccagattcacatcgtctccttgatggtatggataaaagagaaccagatgatccaagtccttatctcttagctatatggacaccaggtgaaacagcgaattcggcacaaccgcctgaacagaagtgtggagggaaagcgtctggcaaaatgtgctttgacgagacttgttctgagtgtaacagtctgagggaagcaaactcacagacagttcgaggaactcttctgataccttgtcggactgccatgagaggaagttttccgctcaacgggacatatttccaagtcaacgagttatttgcagaccacgagtccagtctcaaacccatcgatgttcctagagattggatatgggatctcccaagaaggactgtttacttcggaacatcagtaacatcaatattcagaggtctttcaacggagcagatacagttctgcttttggaaaggattcgtatgtgtccgtggattcgaacagaagacaagagcaccgcgtccattaatggcaaggttgcattttcctgcgagcaaattgaagaacaacaaaacctaaagatgactggaagaaagcaaacgcattgcttctctgctctcctctatttaaagccaggaaaagtcccatttagacataataacaggaatccaaataggctattttctctttctttcttatttcattcatagagcagaagcgacacaaaaaagttttttgggttatttattttctctctaacaaatttgtagcgttttgggtctttttctggctgtcactagcgtggcaaatccaatgtctgcgcacacttaggcgcattgtcaataaaatttctccggccaccggagtgtttagcatcttttaaccggcg

SEQ ID NO: 480 - DNA, 744 bp, Arabidopsis thaliana
gtaagctcaagagaggctgagtacactgagctgcgatcggcgactgtctcttgtccgggatagtgaaagatgaagctgaaggttgtgtatcgtaaggtctccgattacatctgttacgatctgaaagaaatcgtcttaccttcatcacttcccgatcctcctcacgtcgttaaacgccgcaaattgacttggcacgagcgattcctcgtgttgaaggaagcttcaaggctttatgctgcaagctgggtaagagatataggtcctgaacttcgtccaaatgattacaagaagcaaggggatgctgagcctaaaaaacaagcgaaagaggcagagaacgagccctctgttttggaagatcttgcggtagctgcaagaggtggcatggagactttaaggcctgctttacatcgtctttacatgacacgagcttctaattataaagatgctcttacaagctttattaaaggttaccatgagggtctgcagcaagttatgcagaataaagcagagtctgaagccccagcagatgaagctgacaagtccaaaaagactacctgaccttttagttagctccaaaagcaggatttattttgtgaatgcgagtatgtacgtagctagatcttgggttctttgatggtgtaccacaacaatctaaagatttctatcaactacgtagtctttcatgctcaatgtaccctatttgtgaagtaacttctagtaaacaaaaaaatttagcttgacact

SEQ ID NO: 481 - DNA, 3647 bp, Arabidopsis thaliana
tcgtctcttttaaatctccgagttttcttcctccttctctaaaagaacatggcgtttcttaccgcattgttcctgtttctcttcttctctttttcgagttccgccattgttgatcttagctcggaaacaacttctctcatctccttcaagcgctcactagaaaacccatctctcctttcttcatggaacgtttcgtcttccgcgtctcactgcgattgggttggcgttacgtgtctgcttggacgagtcaactcgctctccttaccgtctttgtctctgagaggccagattccgaaggaaatttcgagtttgaagaaccttagagagctttgtcttgccggaaatcaattctccgggaagattccgcctgagatttggaatctaaaacatctccaaacccttgacctctcaggaaattctctcaccggacttctcccgaggctactcagtgagttacctcagcttctctacctcgaccttagtgacaaccacttctccggttcacttcctccatcgttcttcatcagcttacctgcactgtcttctcttgacgtctccaacaactctctctccggcgaaatccctcctgaaatcgggaaactgagtaacctctccaatctttacatgggactcaactcattttccggtcaaattccgtcggagattggtaacatctcgttgctgaagaactttgctgcaccttcttgcttcttcaatggaccgttaccaaaggagatttcgaaactgaaacacttagcaaagctcgacctttcttataatccactcaagtgttccattcccaaatcgtttggagagttgcataatctgagtatactaaatcttgtctccgcagagcttattggattgatcccaccagagcttggtaattgtaaaagcctcaagtcactgatgctgtctttcaattctctctctggacctttgccattggagctttcagagattcctctgttgacgttttctgctgaaaggaatcagctttcgggttcattgccttcatggatggggaaatggaaggtactggactcacttctgttagctaacaatcggttttcaggtgaaatccctcatgagattgaggattgtccaatgttgaaacatctcagtctagctagcaacttgttaagtggttcgattcctagggagctctgtggttcaggttcgttggaggcgattgatctctctgggaatttgctttctggaacaattgaggaggtctttgatggatgttcctctcttggagagttgttacttactaataatcagatcaatggctctattcctgaggatctttggaagcttccattgatggcacttgacttggattccaacaacttcacaggagaaatcccaaagagtctctggaaatcaacgaacttgatggagtttacagcttcttataatcgtctagaaggttatttgcctgcagagattggtaatgcagcttcactgaagcggttggttctcagtgataatcagttaacaggtgaaatcccaagagagattggaaaactcacatctttgtctgtcttgaatctgaatgcaaacatgtttcaagggaagataccagttgagctcggtgattgtacttctttgactacattggatctaggcagcaacaatcttcaaggacagattccagacaaaatcactgctctcgctcagcttcagtgcctggttctctcttacaacaatctctccgggtcaattccatcaaaaccctctgcttatttccatcagattgagatgcctgatctcagctttcttcagcaccatgggatatttgatctctcctacaatagattgtctggccctataccagaagaacttggcgagtgtttggtattggtagagatttcactgagcaacaaccatctctctggagagattccagcttcactctctcgtttgaccaacctcacaatcctggatctatctggaaatgcactgactggatctattccaaaggagatgggcaactctcttaagttgcagggattaaacttggcgaataatcagctcaatggccatattccagaaagctttggcttgttaggtagcttggtgaagctaaacttgactaagaacaagcttgatggaccggttcctgcttctcttgggaacttgaaagagcttacacacatggacttgagctttaacaacctaagtggcgagctttcatcagaactgtctacaatggaaaaacttgtcggcctctacattgagcagaataagttcaccggggaaataccttcagaacttggtaatcttacgcagctggagtaccttgatgtttctgagaacttgttatctggagagataccaacaaagatctgtggattgcccaatctggagttcttgaatctagccaagaacaatctgcgaggagaggtgccgagtgatggtgtttgtcaggatccttccaaggcattgctttcagggaacaaagagttgtgtggcagagtggttggatcagattgcaagatcgagggaactaagttgaggagtgcttgggggattgcaggactcatgcttggctttacgatcatcgtttttgtgtttgttttctctctgcgcagatgggctatgacaaagagagtgaagcaaagagatgatccagagcgaatggaggaaagcagattgaaagggtttgttgatcagaacctgtatttcttaagtggaagcagatcaagggagcctttaagcatcaatatagcaatgttcgagcagccgcttctgaaggtgcgtttaggagatattgtcgaggctacagatcatttctctaagaagaacattataggagacggtggttttgggacggtttacaaagcttgtttaccaggtgagaaaacagtagcggtgaagaagctaagtgaagccaaaacgcagggaaaccgagaattcatggcagagatggagactctagggaaagtgaagcatccgaatcttgtgtctttgcttggatattgctctttcagtgaagagaagcttctggtatatgagtatatggtaaatggaagcttagatcactggttaaggaaccaaactgggatgctagaggttctggactggtcaaaacgcctcaaaatcgcagttggagctgcaagaggtctagctttcctacatcacggtttcatccctcacattatacacagggacatcaaagcgagcaacattctgttagatggtgattttgaaccaaaggtggcggattttgggctagcaagactaattagtgcctgtgaatcccatgttagtacagtcatagcagggactttcgggtatatcccaccggagtatggtcagagtgcccgagccacaaccaaaggagatgtctatagctttggcgtgatactattggagcttgtcacagggaaagagccaaccggtccagactttaaggagagtgaaggagggaacttggttggttgggcgattcagaagatcaaccaagggaaagctgtggatgttattgatccactgctcgtatctgtggctttgaagaactctcagcttcgtctgcttcagatagctatgctttgtcttgctgaaacgccagctaagcgccctaacatgcttgatgtgttgaaggctcttaaggagatatgagccatataaccttaaatgtt

SEQ ID NO: 482 - DNA, 1541 bp, Arabidopsis thaliana
atcagtttaaagcttacatctgacttctctctcacaaaaacatcgtgaagaatggaggagtcacgagaatcgccggcggaacacggctactacatgccggcggaatgggattctcatgctcaaacttggatcggttggcctgaacggcaagataactggcggcacaacgctttacccgcacaacgagtgtttgcagatgttgcaaaggccatctcaaagttcgagcctgtcactgtctgtgctagccctgctcagtgggaaaatgcaaggaaacagcttccagaggatataagagttgttgagatgagcatgaatgattcttggttccgcgactctggaccaactttcattgtacggaaaagaccagtaaagctcagttctcttaaccgaaacattgctgggatcgactggaatttcaatgcctggggaggagctaatgatggctgttacaatgattggagtcatgaccttttagtttcacgaaagattctcgctttggaacgaattccaagatttcaacattcgatgattcttgaaggaggcagcatccatgtcgatggggaaggaacctgccttgtcacagaagagtgtctcttgaacaaaaaccgaaaccctcatatgagtaaagagcaaatagaggaagaacttaagaagtacctcggagtacaatcatttatctggcttcctcgtggtctttacggggatgaggacacaaatggtcacattgataacatgtgctgcttcgctagaccgggagttgtgttattgtcttggacagacgatgaaaccgatcctcaatacgaaaggtctgtggaagctctttcggttttgtcgaattcgattgatgctcgtggaaggaagattcaagtcattaaactttatatcccggaacccctttatatgactgaagaagaatcgtctggaatcactcaggatggtgaagctataccaagacttgcagggacaagactcgcagcatcgtatgtgaatttctacatcgccaatggaggaataatcgctccacaattcggtgatccaatacgtgataaagaagcgattcgtgtcctctcggatacatttcctcatcactcggttgtgggaatcgagaatgcaagagagatcgttcttgctggaggaaacattcattgtataacgcagcagcagccggcggagcctacttccgtcgccgaaaatggccactgactgtctctgcgcgccaccgagggatttatgaatcctggccgttgatattttaaaatacagatttgaagcttgaggacgaacgagagccgttcattaattggatcctgtattttatggttcgttgactaagaaatatattattgggtcatcattccgatcaaactttgcttgcattatggcataacaattagatttttgttctgttaattatgcaagtttgaataattaatttacatttgtatttttttagtagaattttcattttttttttcttaatttggccattcaaatctctacttttgaagtatttcattgttagttgttatattagttccata

SEQ ID NO: 483 - DNA, 840 bp, Arabidopsis thaliana
agaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatattccttggatagaagacaaaaagagaaagtgaatagtgattttgacctatgattatcgtacagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgttt

SEQ ID NO: 484 - DNA, 1452 bp, Arabidopsis thaliana
aactttcaggtattacttgtcaataagatgtgaaattgaggctctccatcgttctctattcattcttcagagtcaaatcttcgaaagtctcgagctttgaagaaacccttttgctcaatccggaatagggtttattgtgctcagtcttcaagtgcagctgtagacgaatccaagaatataactatgggagactcttttatccgtccacatttgagacaattggctgcttatcagccaattttaccctttgaggtattgtctgctcaattaggaagaaagcctgaggatattgtcaagttagatgctaatgagaacccatatggtcctcctccagaggtttttgaagcattaggcaatatgaaattcccttacgtttatcctgatccacaaagtcgtagacttcgtgatgcactggctcaagactctggtttggagtctgaatacatacttgtaggctgtggtgctgacgaacttattgatttgatcatgagatgcgtgttagatcctggggagaagattatagattgtcctccaactttctcaatgtatgtgtttgatgcggctgtgaatggagcaggtgtcattaaagttccaagaaaccccgatttcagcttgaatgtagaccgcatcgctgaagttgtagaactagaaaaacccaaatgcatattcctaacttctcccaacaatccagatgggagtatcatcagcgaggacgatctgttgaagattctagaaatgccaatacttgttgttctagatgaagcttacatcgaattctcaggagttgaatcacgcatgaaatgggtgaagaagtatgaaaaccttatcgttctccgcacatttagcaaacgagctggtttagccgggcttcgagttggatatggagcgtttccgttgagtataatcgaatacctgtggagagcaaagcaaccgtacaatgtctctgttgcaggggaagtagctgctttagcagcactctcaaacgggaaatacttggaagatgtgagagacgccttggtacgggaaagagagagactgttcgggctattaaaagaagttcctttcttgaatccatatccgagctattcgaatttcattctctgtgaggttacatctggaatggatgcaaagaagctgaaagaggatttggcgaaaatgggtgtgatggttcgtcattacaacagtcaagagcttaaaggttatgttcgagtttctgctggaaagcctgaacatactgatgttctcatggagtgtcttaagcaattttattgacttccccatttgtttgggaattcttaaaacagccacacaaaaataaaattgattttttttccctccttttttgtttgttttcacttgttggattcagtgtttgaccaaaaaaaaaaggattcattgtttttgtttcagttaacaaggagaagcttttgttgtattgtactttttggtttg

SEQ ID NO: 485 - DNA, 1102 bp, Arabidopsis thaliana
gcaaaaccctaaaagctgagccgcgtcgagagcattttatatcttcaatcatcttacgcaggctgttgtagcagcagtgtctatcggagacgatgaagttcaacgtcgccaatccgaccaccgggtgtcaaaagaaactcgagatcgatgacgatcaaaaactccgcgcctttttcgacaagaggctctctcaggaagttagcggagatgctctaggcgaggaattcaagggatacgtattcaagatcatgggaggatgtgacaagcaaggtttcccaatgaaacaaggagttctcactccagggcgtgtccgtcttttgcttcaccgaggtactccttgttttagaggacacggaaggaggactggagagaggagacgaaagtctgtccgtggttgcattgtgagccctgacctgtctgttcttaacttggtcattgtgaagaagggtgtaagtgatcttcccgggcttaccgacactgagaagccaagaatgagaggtcccaagagggcatcaaagatccgcaagttgtttaaccttggaaaagaggatgatgtgaggaagtacgttaacacttaccgccgtaccttcacaaacaagaagggcaagaaggttagcaaggctcctaagatccagaggcttgtgactccattgaccctccagaggaagagagctagaattgctgacaagaagaagagaatcgccaaggctaactctgatgcagctgattaccagaagcttcttgcctccagactaaaggagcagcgtgatcgccgtagtgaaagtttggccaagaagaggtctagactctcttctgctcctgctaaacccgttgctgcttaaactgcctcaagattaagaaatttctttctctctagtttgtttctggtcgtatttaagttgctccacagacatgagaacgccattttgaacactatttttggtttctgttttgtgtcaacttttcaagccttttattatatcaaagttttgaacctcttagtagtacgtttgttatatttagttcttatttatatgcccgtttgttgatagtaaatgaccagatgtcttcattattagataaactgatgacctacctttaa

SEQ ID NO: 486 - DNA, 1005 bp, Arabidopsis thaliana
gtaattcataaatgctcctctcctccgatctctccgccataaaatctactctttcttcttctgggtgttcaaagaattagtcgttctcgcgtattcactttccatggcgggctttctctccgttgtccggcgcgtgtacctcactctctacaattggatcgtctttgctggatggttttgtacttagcgataacgacgttgaaggaaacgggttatgagaatgtctatgacgccattgagaagcctctccagcttgctcagactgccgccgttctcgagattcttcatggattagtaggtttggtcagatctcctgtttctgcaactctgccacagataggttcaaggctatttctcacttggggcatcctatacagttttccagaggtccgatctcattttcttgttacgtcgctggtcataagctggtctatcacagagattattcgctactcattcttcggctttaaggaagctctaggctttgcaccttcatggcacttgtggctcagatacagcagctttttattgctataccctaccggtatcaccagcgaagttggtcttatctaccttgccttaccacacatcaagacatcggagatgtacagcgttaggatgcctaacatattgaacttctcatttgacttcttctatgcaacgatactcgtccttgcaatctatgtcccaggtagcccacacatgtacaggtacatgcttggtcagcgaaagagagctctctccaaatccaagagggaataaaagaaaagatttagaaagagacgaaaaagctcatcaactgttttctcctcttgtcttgttcgttcatgtactactagtctactactacaacttgtcttttgtttagcttgtttgagcttttacttcctcggcgattacttgaacttacatgcagcaggatactattaagtgtaatgtggtttctaaattaataagaaaatcattggttccttctcagtagaaatgaaaaagttgatttaagct

SEQ ID NO: 487 - DNA, 243 bp, Arabidopsis thaliana
atggcggcgatgaaatacaaaggaagcgtttttatcatattagtcatccttcttctttcgtcctcactacttgctcactcttcttctacaaaatccttcttttggttaggagaaacacaagatacgaaagccatgaaaaaggagaagaagattgatggaggaacagctaatgaagttgaagaaagacaagttccaactggatccgaccctcttcatcataaacacattccttttactccatag

SEQ ID NO: 488 - DNA, 3204 bp, Arabidopsis thaliana
atgattctcaaaacggctttttctctacccacacctactactactctattatctcccagctctcctcaccagctcaacactctgttcttcactcgccgacgccgtcgattaatttccccatcccgcttgaactcaattttctcgcaacgtagattctctttctctgctgctgcgtcaggaaataatgtatttacttctcccgagacatccaagacctttgatttttcttcggaggagaagatatacaaatggtgggagtcgcaaggctacttcaaaccaaattttgaccaaggaggcagtccttttgtgataccgatgccacctcctaatgttactggttctctgcacatgggccatgcaatgtttgtcactcttgaggatattatggttcgatacaataggatgaatgggagaccaacactttggcttcccgggactgatcatgctggtattgccactcagttggtcgtggaaaagatgctagcgtcagaaggcattaagagagtggacttaggtagagatgagtttaccaaaagagtctgggaatggaaggaaaagtatggcggaaccatcacaaatcagattaaaagactgggtgcttcttgtgattggagtagagagcgctttactcttgacgagcaattgagtcgagctgtggtcgaagcttttgtgaagcttcatgacaaggggttgatatatcaaggatcttacatggtcaactggtccccaaatttacagactgctgtttcagacttggaagtagaatattcggaggaacctgggtttctataccatattaaataccgtgtagctggaagtcctgattttcttactatagcaacgactcgtccagagacattgtttggtgacgtggcccttgccgtgcatcctgaggatgatcgttactcaaaatatgttggtcagacagcaattgtacctatgacatatggtcgtcatgtcccaattattgctgataagtatgttgataaggattttgggactggtgttctgaagataagtcctgggcatgatcacaacgattaccttcttgcaagaaagctaggtctccccattctgaatgtgatgaacaaggatgcaacacttaatgacgtcgctggcttgttttggtttgaggtgagggagaaactatgggcagatcttgaggagataggtttagctgttaagaaggagcctcacactttacgagttccaagatctcagcgtggtggagaagttattgagccacttgtaagcaaacaatggtttgtccacatggatcctttagctgagaaggctcttcttgctgttgaaaacaaagaacttactatcatacctgagagatttgagaagatatacaatcactggctgacaaatattaaggattggtgcataagccggcagctgtggtggggacatcgcataccagtttggtatgtggttggaaaggattgcgaggaggactacatagttgctaaaagtgctgaagaagcccttgagaaagcccttgagaagtatggaaaagatgttgaaatatatcaggatccagatgttcttgacacctggttttccagctcgttgtggccattcagcactcttggctggcctgatgtagcagcgaaggatttcaataacttctacccaacaaatatgttagaaacagggcatgacatactatttttttgggtagcaagaatggttatgatgggaatagaatttacagggaccgttccattttctcatgtctaccttcatggacttataagagactcacaagggagaaaaatgtcaaaatctcttgggaatgtgattgatccgcttgacacaattaaagattttggcactgatgctctgagatttacgattgcactaggaactgctggtcaggatctgaacttatctactgagaggttaactgcaaataaagcattcaccaacaaactctggaatgctggaaagtttgtgcttcatagtctgcctagtctaagtgatacatctgcttgggagaatttgctggacctcaagttggacaaagaggaaaccctgcttagtttacccttgcctgagtgttgggcggtgtcaaaactccatattctcattgattctgtcacagcaagctatgagaagttgttctttggggatgtaggaagagaaacatatgatttcttttggagtgactttgctgattggtatattgaagccagcaaatctcgactgtatggatctggaggcaattcagtttctctagcttctcaggcggttttgttatatgtctttgagaatatacttaagctgttgcatccgtttatgccgtttgtaaccgaggatctatggcaggcacttccctacaggaaagaagcgctcattgtgtctccatggccacaaaattcacttccaaggaatgttgaatcaataaaaagatttgagaatttacaagctctgactagagcaattcgaaatgcacgagcagagtattcagtggaaccagtaaagcgtatatctgcctcagttgttggaagtgcagaggtcattgaatatatttcgaaagagaaggaggtattagctcttctatccaggcttgacttaaacaacgtccatttttccaatgcccctcctggtgatgcaaatctatcagtccaccttgtagccagtgaaggactcgaggcatatctacctcttgcagccatggttgatatatcatctgaagtccaacgcatttctaaacgtctctccaagatgcaaactgaatatgacgccctcataactcgtctcagttcaccaaagtttgtggagaaagctccagaagaagtggtgagaggtgtaaaggagcaagtagaagaattagaagagaagataaagttgaccaaagctaggcttgattttctcaagtctactacttctttagtgtctcagtaaattcaggtagttcttattctctcaagttcggacccgaccaatagcggcccatggaccatttaattgtgatcatttgagtcgatgagactacctactattaatatttctgttttttgaggacccaattagtttgaaaatgcccccaaaaatgatcaattgtcaactattttaccagtcctattgtcggggcccataatgccttttaagcagaaagtggattttatttttattttattttgacagcagaaagtggatatattattaatttattatatttgctggttatgttac

SEQ ID NO: 489 - DNA, 1287 bp, Arabidopsis thaliana
gacgaggaagagtagaaccgtttgccctctctctctctatcttccttatctctctccgccactctccttctctttctccgaactcttcgatggccggtctactcaaaacgccgtctttacatctcacaccaactcttcttcatgctccttctgtaccctttaagcccttttgcgtatctttcgccggaggaagaaacgttagcgtctcactctctcgccgagcttctctccggtctgtctctagcggctatcctctccgcttactaaacctcgtaccctttgcttcgggagaagctgagacgacggagacggaggtggaatcgaacgaacccgaagttcaggagacggatggtgctgttgatgtcgagaatgaaaatgccagtgctgaggagggtgaagctgaggaagaagaagcagctgttatcacagcgttgctgaaatcctataaagaagctttagcagacaacaacgaggggaagattgctgagatagaagcatctttaaagtccatagaagatgaaaaatttctgcttgcggataaagtagcgtctttatccaatgagttatcggtggagagggatcggcttataagaatcagtgcagatttcgacaacttcaggaagaggactgagagggaaaggctaaaccttgtttcaaatgctcaaggagaggttgtagagaatcttttggctgttttggataatttcgagagagctaaatcccaaattaaggtggagactgagggagaagagaaagtcactaatagctatcagagcatatacaaacagtttgtagaaattctgggatcacttggtgttatccatgtggagacagtcggcaagcagtttgatccaatgctacatgaggcaataatgagagaagactctgcggaatacgaagagggtatagtactagaagaatacaggaaaggtttcttgctaggtgaaaggcttttacgtccttcaatggtgaaagtatcagctggacctggaccagaaaagccccttgaagctgaaggagaagaagccacagcacaaggaagcgcagaagaagaatcatcttcatcttgaaattgaagatgatcaagactcagcagttttgtgtgcgtgtgtgtgagagagatacagagataaaagagggagaggtctgttttaccattattgttgttattgttattgatacgttatatcatttctacagagtctagaagtaatatagatcgacatttttaatgaattcttaagtattcaatccgaaagggaatgccataattgattttttttcatc

SEQ ID NO: 490 - DNA, 4308 bp, Arabidopsis thaliana
atgaatcagtaccacatctacgaagctattggacatggcaaatgctcgactgtgtataaaggaaggaagaagaagacgatcgagtattttgcctgcaagagtgtcgataagtcgcggaagaacaaggttcttcaagaggtcaggatccttcactcgctaaatcatccaaacgtactcaagttctatgcttggtatgaaacttctgctcacatgtggttagttctggaatattgcgttggtggtgatctcaggacattattgcagcaggactgtaaactgccagaagaatctatctatggtcttgcttatgatcttgtcatagccctgcagtatttacattcgaaaggaattatatattgtgatctgaaaccatcaaacatcttacttgatgaaaatgggcatattaagctgtgtgattttggtttgtcaaggaagctggatgatatttctaaatctccttccacgggaaaacgtggtaccccgtattatatggctccagagctatatgaagatggagggatccattcttttgcttctgatctgtgggcacttggttgtgtactatatgaatgttacacaggaagacctccttttgtggcaagagagtttacccagcttgtgaaatctattcattcagatccaactcctccactccctggaaatgctagtcgttcatttgtcaatctcattgagtctcttcttatcaaagacccagctcaaagaatacaatgggcagatctctgtggtcatgcattttggaagagtaagataaatttagttcagttgcctactcagcctgcttttgatgatatgattggcataaacacaaagccatgcctttccgagcgtaatggagatagaccaaataagacccctccaaagtaccgggagaaagatcgaaaagggggttcaaagcaaaatgagaactccattcaaggttcaaaaggccatgagacgccgataaagggcacccctggtgggtctaaagctcaagcaaagcttcctagtagagcaactgaggaaaagcatggaggtcgtcctgctgctaacagacaggtgaatattctaagattgtcaaggatagcaaaggcaaatcttcaaaaggaaaatgagaaggaaaactataggagacccttacctaatagcaacgagaattgtgcagaagtgaagatcgacaacactgatatggaacttgattttgatgaaaacaatgatgatgagggacctgatgaatcagaaggaaccgaaaacacctcttgtgcacaagaagaaagagtaatgagccataatgagaatcacagaagacaaagagttgtaagcagtaatgtgcctgatgagaactcgtctgcaaatgaaacaccaaccttgggtgaagcaagagattgccatgaagatcagtcagagccaatggacatgtcagctgccccacctagtgctagtcctcaacttaaaactcaccgaggaagagaaacttctggggttgctgttaatcatgactcatctaaagcacctactagcctcactgacgtcttttggcatatatctgatctttctgttaggcctgtcatgcccagcagaaaatctgacaaagaagctgtgcattctctctcattcgaaacaccacagccctctgattttagtaagaagggaaagcaagaattagaaccgctgaacaataggatcataacagttctaagtgggagcagttctggactgtcagagaaacagaatttgatcagatacctcgagacattgagtaccaatgctgatgcagccaacatcctgactaacggaccaataatgcttgtgcttgttaaagttctgagattatccaagaccccagcatttcgtgtacaaattgcttcactaattggtttgttaattcggcattctacttcaatcgaagatgacttggcaaattctggtattttagactctcttactaatggcctcagagacaagcatgagaaagtgagaagattctctatggcagctctaggtgaattgctattctacatctcaactcaaaatgagcataaggatttcaaaccaccagaatccccatcaaaagaaacccggtctgcatcgggttggcaggtttcaaatgccttgatctctcttgtatcatctgtcttacggaagggagaagatgacctgactcaggtttatgcgttaaggacaatagaaaacatctgcagtcaaggagcttactgggccacccgtttctccagccaggatttgattagcaacctctgctatatctacaaggcaacggggaaacaggagagcatgaggcaaactgctggatcctgtttagtccgtcttgctcgctttaaccctccttgcattcagacggtcgtggaaaagctttcattgaaggaaatagcttcatcttttgtcaaaggcagcgcaagagagcagcaagtctgcttaaatcttctgaacatggctatgattggaagtcatacattcacaagctttggaaggcatctcgtgacattgacagaggagaagaaccttttccctagtttactctccatcatagagcaaggaacagaagttctgaggggcaaagctcttctctttgttgcatttctctgcaaaaacagtaggcgttggctgacaaatttcttctgcaatgcaagatttcttcctgtggtggacagattagctaaagaaaaagacagttacctgcaacaatgtcttgaggcatttgtgaatgtaatcgcctccataataccgggcatgctggatacaataaccaatgatatccaacaactgatgacaggaagacgccatggacctgtctctccccttaatagtcgagctcctgtaaagactaatgcacacctgttccctgtggttcttcaccttctgggaagctcttcgtttaagaacaagatggtaactccacaagtcctaaggcagttggcaaatcttacaaaacttgtggaagcatcgtttcagggaagagatgacttccgtgtaacccttcttcaagttctagagtgcataacaggagatgcgcctctggttacacaaaatggtgagattattatccgtgagattctcccatctctggctgcaatttacaatggaaacaaagacggtgatgctcggtttctctgtttgaaaatctggttcgattcattgaccattctcttaactgagtgcaccgaaatcgagcaacaaatatcggaggatttgaaatcaatatccaactctcatttcctcccactctaccctgcactgatccaagacgaagatccaatcccagcttacgctcaaaagctccttgtcatgctcgttgagtttgattacatcaaaatctccaacttattgcgtcacaatacggtttcacaatgcttcgagtttcttctcggagacttatcaagcgcaaatgtgaacaatgtcaagctctgtctcgccttggcttcagctccagagatggaaagtaaactactctctcagctcaaagtagtgaggagaatcggaaatctgctggaattcgtgaatgccaaagatatggaagatttcctagaacccactttaagtctctgcagagcttttctgctacggtcacttgggaacaagaaaggtctcagttccaactacacaaaagagccaacgcttttatcagaggcatcttttacgttcgaggttgatccacaggaatgcataagagacattgcagatttcggtagcaacattggcctattcttgcactttgcaggcttagacgatgacacaagcatcgcagtcgcagatattgcctctgaatgtgttgtgttgctactcaaagcggcttcgagagaagccacgacgggattcttaaccaatcttcctaagatcacaccgattctggactcgtggcgcaggaggaagagcacagagctacacttgttggttctgaagagagtcttgcattgtttgggttatgcttgcaagcagtatctatcgcaggcgatgattttgtcgatatcgggacacgatgtctcaaagatcaacgcaattgtctctgagatgaagaactcagacgccgctggtcttaacagcatcgcttcactcgttgccatggagttgcagagattacctcgttgaatttgaagtcatctgaacaatggattaacgacgacaatgacgctgagctgtagattttgagtacatgcgaggtaaaacaaacgcaaaaacatgtgacaaagtgaaacccagaatcaagatttgtctcttcttaatgtatatttctttctattgcaatttttgtaccactaatacaatctacttccttaatattatcttcttttagac

SEQ ID NO: 491 - DNA, 1290 bp, Arabidopsis thaliana
aaaagctccctgagcaagtgagaagagaccacactgagaagaaaaatccttcaggttatcgaaaattcccggattttactctttgggcggtggccgatttcttacgcgctctttttgtggcgactgttgtatacgcgcgagccttcatggacacgaaggcggttggagtttctaaggatacggcggcgtcgatggaagcgtcgacggtgtttcctgggtttaaattctcgccgacggatgtggagttgatttcgtattacctgaagcggaagatggatggcttggagaggtccgttgaggttataccggaccttgagatttacaatttcgagccttgggatttacccgataagtcgattgtgaaatctgatagcgagtggttcttcttctgtgcgcgtgggaaaaagtatccacatggttcacagaacaggagagcaacgaagatgggatactggaaagcaactgggaaagagcgtgatgtgaagtctggttctgaggtcattggaacaaagaggacgcttgttttccatattggtcgtgcaccaaaaggcgaaagaactgactggattatgcacgagtactgcgtgaaaggagtatctctggatgatgctatggttgtttgccgggttaggaggaacaaagaatacaatagtggtacaagtcagaaggcaccaaagccaaattcatcagccgagaagcatgcgaaagtccaaaatggcgctacgagttcagggagcccgtctgattgggacaacttggttgatttttacctagcaggtgaatcaggggagaaactactcgctgagatggcagagtcatcagaaaatctacaggtggataatgacgaggatttctttgcggatatcctaagagacgaaatcatcaatctcgatgaagcggtgatgacagggaacacaccaaacgaagtgccaacactagaatcagcatcaatggagataagggtacttcctttaccaaacatgatagacaaacaaatgtcatcactgttagaggaaagaccatcacagaagaagaaaggaaaagacgccacggaatcattgtcgagctgcttcgtgggtttatactcgatcaaatcagtgaacaaggcacgatgggatgttattataggtgtagtggctctgatagcaatgttgttttatctagaataagaggcttatggaagtagcgaaaaacagtgtcctagctatgtttgtatcatcttttctcggacattgacaaggattatatgatgtttttgtgtaaacggtttatgttttacacttctacttc

SEQ ID NO: 492 - DNA, 1192 bp, Arabidopsis thaliana
acttcgccttgaatcgagtcttcgacgagtctccggctgcgagtttctcttgctccggcaaacagacctgtcattgcttctctctccggctaactacacagcatggtgtttggacaagtagtaataggtcctccaggatcgggaaagaccacttattgcaatggaatgtctcagttcctctctctaatgggcaggaaggttgctattgttaatctggatcctgcaaatgatgcattaccttatgagtgtggtgtgaatatagaagaattgatcaagttagaagatgttatgtcggaacactcgcttggtcctaatggaggtcttgtatattgtatggagtacttggagaaaaacattgactggctggaatctaaactaaagcctcttctgaaggatcattacattctctttgattttcctggccaagtggaattgttcttcattcatgacagtaccaagaatgttctcacgaagctgattaaatcattgaaccttagattaactgctgtgcaactaattgattcccatctatgttgtgatcccgggaactacgtaagttcgctacttctctccttatccacaatgcttcacatggaactcccacatgtcaatgtattgtctaaaatcgatctgattggaagctacgggaagctagctttcaatttagatttctataccgatgttcaagacttgtcatacttggagcaccatcttagtcaagatcctcgctctgctaagtacagaaaactaacaaaagagctatgtagtgtcattgaagattacagtcttgttaattttacaaccttggatattcaggataaagaaagtgttggggatctagtaaagctcatcgacaagagcaatggatacatatttgccggcattgatgcaagtgtggttgaatacagcaagattgcaattggtcaaactgattgggattataacagagtcgcagctgtacaggagaagtacatggaagatgaggaaatacaagactgagaacagtgcttgaaactttatatagaagagagctggtttaaaatatctctgaaccaaaccatttgacggtttgtatgaacctttttgtgtatttttgagttcggtttaagtctaaacaacattgatttacacaacttcctggtttggttcactggattatgctaattttccagacgactaactttctgccaaa

SEQ ID NO: 493 - DNA, 1248 bp, Arabidopsis thaliana
aaagtcaaagttgttcactttacctataaaaacgctctctcactttcttttcaatggcttcttcttcttgtttccttcgctcgattctcttctcttctcctactaaccttcgttcaaatcaccatctccccactttcttccccaagaattatctcatttgctctcattccacttcttctcgcttcgaatcgctctcggtttcatcgatcggaactggatctaccaagaaatcatccgatactcggagaaaggtaaagagcatggctacgacaaatataggaaaggaggagaagaaaagagtcgagatttatgatctcgaagagaatttagtgattgatttggctaaattcacagcagatctctccgataagttttgtaaagagagaggcgctttcaccgtcgttgtctccggtggctctctcatcaaatcactccggaaattagtagaatctccttacgttgattctatagattgggcaaggtggcattttttctgggttgacgagagagttgttcccaagaatcacgatgatagcaactataaactcgcttatgatagttttctatccaaggtaccaattccgcctggaaatgtatatgcaatcaacgaagccctctccgctgaggctgcagcggatgattacgagacctgcctcaaacatttggtcaacaccaacattctccgtgtatctgaatcaactggctttcccaaatttgatctcatgcttctaggtatgggacctgatggtcatgtggcatcattattccctgggcatggtctctgcaacgagagcaagaaatgggtagtttcaatctctgactctccaaaaccaccgtctgagagaatcaccttcacgttcccggtcatcaactcatctgcacatgtagctctagttgtttgcggttctgggaaagctgaagctgtggaggcagctttaaagaagactgggaatgtaccacctgctggttctgtttctgctgaagacgagttggtttggttcctggacaaaccagcatcttccaagctctaaaaacaggtggtatgcttcccattccagtgaacttaccaatgtgactagtccggtttagtttttggattttgactctttggttctctccatttatgttgtgggaagagactgttgtgataaaagcgtgtactttacatggaaataatgaactaatcaatggtttctctgatttgttttggtgtattttggttaaaatctatcggaaccaacactctcc

SEQ ID NO: 494 - DNA, 2257 bp, Arabidopsis thaliana
atgtggcaaacgtggccacgtcagccaattctactagatattttttcaaatccaaatactctttccacaaccgttagatcatggtcggttcgccacccactttcaatcataaccgttaaaacattcgctagattttttctagatattttcttttctccacactattatagaaagaataaagttcttttttttgctctcttctcatttatctctccactcacaaatattttgatttgttttgtaactgtttctctttctctggagctttcttcttcttcttcaataatcgatttaggtttttcaaagctaagtgtttgtgttgtgataatgactagtagcgaggaagtagttgaagtgacggtggttaaagcacctgaagctggcggaggaaagttatcacgtcggaagattcggaagaaagacgccggtgttgatggtttggtgaagtgggagagatttctcccgaaaatcgcgcttagagttttgctcgttgaagctgatgattctactagacagattatcgctgctcttctcaggaaatgtagttacagagttgctgcagtacctgatggcttaaaagcttgggagatgctaaaaggaaagcctgaaagtgttgatttgatattaacagaggttgatctaccttcaatatctggatatgctctgctaacacttatcatggagcatgatatttgcaagaacattcctgttataatgatgtcgacacaggactcggtgaatactgtgtataagtgtatgttgaaaggtgcggctgattatcttgttaagccgttgaggaggaatgagcttagaaatctttggcagcatgtctggagaagacaaacttcacttgctcctgatagctttccatggaatgagagtgttggacagcagaaagccgagggtgcgtctgcaaacaactcgaacggaaagagagacgatcatgttgtgagtgggaatggtggtgatgcccagagctcgtgtacaagaccagagatggaaggtgagagcgcagacgtggaggttagtgcgagagacgcagtacagatggagtgcgcaaagtctcagtttaatgagacacggcttctagcaaatgagttgcagagtaagcaagcagaagccattgacttcatgggagcatcgtttagaagaactggacgacgtaacagagaagaaagtgttgctcaatacgaatctcggatagagcttgatctttctctgagaagacctaatgcttctgagaaccaatcttctggagaccggccttctcttcatccttctagtgcctcagctttcacacggtacgttcacaggccgttgcagacacaatgttcagcctccccagtggttactgatcaaagaaagaatgttgcagcaagtcaagatgataacattgtgctaatgaaccaatacaatacatctgaaccgcctccaaatgctccaagaagaaacgacaccagcttttacactggagctgactcacctggtccaccgtttagtaatcagctgaattcttggccgggacagagttcataccctacgccaacccctatcaacaatatacagttcagagatcccaacacagcttatacatctgcaatggctcctgcttcactctccccaagccctagttccgttagcccgcatgagtacagttccatgtttcacccattcaacagtaaacccgaggggttacaagaccgggattgttccatggatgtagatgagaggagatacgtctcttctgcaaccgaacatagtgcaataggcaatcacattgatcagcttattgagaagaagaacgaagatggctattcattatccgtcgggaaaattcagcaatctcttcaacgagaagccgctttaaccaaattccgaatgaagcgaaaggacagatgttatgagaaaaaggttcgttacgagagccggaagaaattagcagagcaacgaccacgaatcaaaggccaattcgttcgtcaagtccaatccacacaagctccatagtgatccaacaaattgatatattatatacagttcaattttgtatcatcaactagaggaattttgttttctccgatgcaggagctgttctttgtacaactaattccacatacgttagatttggtgacacatttgtgtgtacatacacatctttcgagcttgttgttgagttttagttagaatctacgttagatctgtaactacatacatttggattacgtttctgtaacttgcaagacgaattagaaagattgac

SEQ ID NO: 495 - DNA, 2933 bp, Arabidopsis thaliana
agggcagaagcagagaagcaaaatcgtggaaggttacaaagcctttcaaaaacctcactctctcaactctcaaaccttatctccttccttctcttctcctctcctctccgtcgagcttactatctccacaaaatggcgtcgacggtaggagttccatcactataccaagttcctcaccttgaaatctccaaacccaattccaaaaagaggtctaattgtttatctttatctctcgataagcctttcttcactcccttatctcttgttcgtagaactcgtcgtatccattcctcttctcttcttgttccttctgctgttgctactcctaattctgttctcagtgaagaagctttcaaaagtcttggtctttctgaccatgacgaatatgaccttgacggcgacaacaacaacgttgaagctgatgatggtgaagaactcgctatctctaaacttagtttgcctcaacgtcttgaagagtctcttgagaaacgtggtatcactcatctcttccccattcagagagctgtgttggtacctgcactgcaaggaagagatattatagctcgtgcaaagacaggaactggaaagactttggcttttggtattcctatcattaaacgtctcactgaagaagctggagactacactgctttcaggaggtctggtcgtcttcctaagttccttgtccttgcgccgacccgagagctggctaagcaagtggagaaggagattaaggagtctgcaccttatttgagcactgtttgtgtgtatgggggagtttcttataccattcagcagagtgctttaactcgtggtgttgatgttgttgttggaactcctggaagaatcattgatttgattgaaggaaggagtcttaaattgggagaagttgagtatttggtacttgatgaagctgatcagatgcttgctgttgggtttgaggaggccgtggaatcgattcttgagaatcttccaactaagcgacaaagtatgcttttctcagcaactatgcctacttgggttaagaagttggcgaggaagtaccttgacaatcccttgaatattgatctggttggagaccaagatgagaagctcgcagagggtatcaaactttatgcaatcgcaaccacatcgacatcaaaacgcactattctaagcgaccttattacagtgtatgcgaagggtggcaagaccattgtttttacccaaactaaaagagatgcagacgaagtttctcttgcattgtcaaacagtatagctaccgaagcacttcatggagatatatctcagcatcaaagagagagaacactcaatgctttccgtcaagggaaattcaccgtattagttgccactgatgttgcatctcgtggacttgacatcccgaacgtagatctagttatccactatgaacttcctaatgacccagaaacttttgtgcaccgttctggtcgtactgggcgtgcagggaaagaaggctctgccattctcatgcacaccagcagccaaaagagaacagtgaggtctctggagcgtgacgtaggctgccattttgaattcattagcccaccaactgttggagacttgttggaatcgtcagcagaccaagtggtggccactctaaatggtgttcaccctgactccataaagtttttctcagcaactgctcaaaaactatatgaggagaaaggaacagatgctttagctgcagctctagctcacctgagtggtttctctcagccgccttcatcaagatctctcctcagccatgagaagggatgggtgactttgcaattgatccgagatccaacgaacgctagaggctttctgtctgcgaggtctgttactggttttctttccgatctttaccgtacagctgcagatgaagttggaaaaatcttcttgatcgccgatgacaggatccaaggagctgtatttgatctaccagaggagatcgcgaaagagctcctagagaaagatgtccccgaaggcaacagtttatccatgataacaaagttacctccacttcaagatgacggaccatctagtgataactacggacggttctctagcagagacaggatgcctagaggaggaggaggttctagagggtcaagaggcggtagaggaggatcatcacgaggccgtgatagttggggaggtgatgatgacagaggtagtagaaggagcagtggtggaggaagcagctggtcccgaggtggtagtagttccagaggaagttctgatgattggttgatcggtggcagaagttcatcaagcagcagagctccttcgcgggagagaagttttggaggttcatgcttcatttgtgggaaatctggacacagggcaacagattgtcctgataagagaggattttagagttatcgtagcaaatggtttctgctcttgggagaaagatccttgtcctttttggtgttcttaatgcgaatcttttcgtgcttgcttcaacggtttgtttcagacggtagagaagcaatcagggaggaggatacatgcttcggacaaggtagagcagaaataaataagagagaggcaatagcaaaagtaaaggagaaggttttcctcaaattggcattttcagagtttgcgtgagaaacaagggaaagctgatggatctttttatgttagggttattataatagtcttaatgatcagtttccatgtttctaaggttttgtttgatttaagtggttattagtcagtctacttacactacttttattttcatttttgtacgttttctattgttatatgtgaattcggatcacatgtgtttggacagaagtaactatgtcattataatagaatcttatgccaagagacttggtgccggattagctctctctataggagagcttcctacaaagatcttaaaacaatgatgtttttgcgggaagaaaataaataaatat

SEQ ID NO: 496 - DNA, 912 bp, Arabidopsis thaliana
aaaaaagttcccattgacctaaaactaaaagaccaccgattcattagaaatccatccctctcactgtcaaaacccgagaagcagaaaaaagcaaaaaacagatttcgaagtttcgacgcctctctattcttcgatctctttcatatttgaatcgttcaccttcttgccgatcttcggagtatattacaaggttcttaacggatctctaaatcttctgatttaagaagatgcttcctctatcgctgcttaaaactgctcaagggcatcctatgctcgtggagcttaagaatggagagacatacaatgggcatttggtgaattgtgatacttggatgaacatccatctgcgtgaagtcatatgtacatcaaaggacggagatagattttggaggatgccggaatgttatatccgtggtaacacaatcaagtaccttcgagttccggatgaggtgattgataaagtacaggaggagaagacacgcacagatagaaaaccaccaggtgttggacgtggaagaggacgtggtgtggatgatggaggagccagaggcagaggcagaggaacttcaatggggaagatgggtggcaacagaggagcaggtcgcggccgtggttgatgcaacaagttttaaagactcgctgccaaatctgctaacttcccattgtggagaaaaccaaaagttacataagaagttggtctgttgttggttttctattaagtatgtaagggatagggagtgtgtttttcgattctccttgtgatcttttcgaaaaatgaaatttgtcttttgcctttttgtggtatatgtgaaattccaattgttttcatttgcgcttaaaaatgaatctttcaggtcttgaatttatataattgttagagaatttatacaattaaccaacgacagggttttt

SEQ ID NO: 497 - DNA, 1860 bp, Arabidopsis thaliana
taaacgtttcccttatctctctctctctctccactccaatggggactctcaccagcgtcgcttttgccgctgccgttaacattagattccgatcatttcaccgggaaaacattaagacaacaattacaactctgcccaaatggcaaaagagactctgtttctcttctacagaggattctcatagatttaggattgcaaagtgtttaggcaatgacgaaaacagtaacagagacgacagtatcggagaaaacggagaaacccacaagtcttcggttgttaaaacggcaacgtttgaagaagaagatgaagagacaagtaagagtagctctactactagcagcagcaacgagttcggttccgacaagacttcaatgccatcaactattgatccaacatatagtagcttccaaatagattcgtttaagctaatggagcttcttggaccagagaaagtagatcctgcagatgtcaagttaataaaggacaaacttttcggttattcgacattttgggtgacgaaagaagagccatttggggaccttggggaaggaattctctttcttgggaacttgagaggaaagaaagaagatgtttttgcaaaacttcagagaaaactagttgaagttgctagtgataaatataatttattcatgattgaggagcctaactcagaaggacctgatcctcgcggtggtgctcgtgttagctttggtttgcttcgtaaagaagtttcggagcctggaccaactacactctggcagtatgtgattgctttaatattgtttcttttgactattggttcctctgtggagttaggaattgcttctcagattaaccgcttacctcctgaggtggtaaagtatttcaccgatccaaatgctgttgaaccacctgatatggagctgctgtatccatttgtagatgctgcattgcctttagcttatggtgtattgggaattcttttgtttcatgaattagggcactttcttgctgcagttccaaagaaagttaagcttagcattccatacttcattccaaacattacactcggcagctttggggcaatcacacagtttaagtcgattcttcctgaccggagtacaaaagttgacatttcgctagctggtccatttgctggagctgcactctcagtttccatgtttgctgttggtctgttcctatctacagaaccagatgcagctaacgacctggtccaggttcccagcatgttatttcaaggttcattacttcttggactcatcagcagagcaactctgggatatgcagctttgcatgctgcaacagtttcaatccacccacttgtaattgctggatggtgtggtttaacaacaacagcatttaatatgcttccagtgggatgtttggatggaggaagagctgtacagggagcattcgggaaaaatgcattggttacatttggtttgtcaacctatgtaatgcttggactcagagtgctcggtggccctttggcacttccttggggactctacgtattaatctgccagagaacacctgaaaaaccgtgtctaaacgacgtgaccgaggttggaacgtggaggaaggcccttgtagggattgcactaatcctggtggttttgacactcctgcctgtatgggacgaactcgcagaagaagtaggcatagggcttgtaaccacattttgatgtcatcttccgtctttgagcagacgttgtagttagggccaatccgagacacatttttttgttttggcaatatttagattgccagatataatgagccatgtatgtacactagtgaaaaagtatttatatgtaattacttaaattcattcttcaattattacactaattacttttt

SEQ ID NO: 498 - DNA, 858 bp, Arabidopsis thaliana
atggaaggaagcaaaagcgaggcagtgttcgattccatgaatctaaatcctcagattttcatcaacgaagcaatcaactccgtcgaagattatgtcgaccaagcttttgacttctatgcccgtgatgcatccaaatctctcaaaatcaaaggatctgataaacaaaagtcacaagctttatcaaatggtattgctcgtgttcgtggtttgctactatctgtaatcgacaatcgtttgaaattgtgggaaagctattctcttcgattctgtttcgcagttcctgatggatttgtgttaccaaagagtgaggagtcttcgtctgtgcatcaggatgggttatatgatctagaattagatgcagaattggattctttaagggataagcttaatgtggtgggaaagaggtctgttgagcttgactctgagctccaggctttagaaagaagctcggtttcgagggaacggtctttgagactcgttaatgaagctttggagctttatgatgagtcttctatggatgaaatattcaaagagatgacgaaaatggcatcggaacttcgtgcaagcgtggagaggctgaaaacaagaagaatgaaagcaagtgaaagcgctaaagtaaagaggctaaagaaccatggcaaagagttttcagcaatgacttttgactacgtcgtttctggcttaccaaacggaggttctaggcaaaagcccgtaatccctccagatcagaaaccacaacatataatattagtttcatcccaagtgtcactcgaattggcgacctctaagcttcgcctaggatctttaccaattgagctaacgacacttgattatttttgtatgtgttttattatgtaa

SEQ ID NO: 499 - DNA, 1604 bp, Arabidopsis thaliana
cttcttaattgtttcctcttgtgttttgttaactttttttctagcattcttgatctgttgttcttgtcacttgttttgttttctgggatcatcaatccaatggctcagatcttagcagcttctccaacatgtcagatgagagtgcctaaacactcatcagtcattgcatcatcatccaagttatggagctctgttgtgttgaaacagaagaagcagagcaacaacaaagtcagaggctttagagttcttgctctccaatctgataacagtactgtcaatagagttgagactcttctcaatttagacaccaaaccttactctgacaggatcattgctgaatacatttggatcggaggatctggaattgaccttagaagcaagtcaaggactatcgaaaagccggtggaggatccttctgagctacctaagtggaactatgatggttcgagtaccggtcaagcacctggtgaagatagtgaagtgattctatacccgcaagctatcttcagagatcctttccgtggaggcaataacatcttggttatctgtgatacttggacaccagctggtgagccaattccaacaaacaaacgtgctaaagctgctgagatcttcagtaacaagaaggtctctggcgaggttccatggttcggcattgaacaagagtacactttacttcagcaaaacgtcaaatggcctttaggttggcctgttggagcgttccctggtcctcagggtccttactactgtggagttggagctgacaagatttgggggcgtgacatttcagatgctcattacaaagcttgtttatatgctggaattaacattagtggtactaatggtgaagttatgcctggacagtgggagttccaagttggcccgagcgtaggaattgatgcaggtgatcatgtttggtgtgctagataccttcttgagagaatcacagaacaagctggtgttgtcctaacacttgatcccaaaccgatagagggtgactggaacggtgctggttgccacaccaattacagtaccaagagcatgagagaggaaggaggatttgaagtgatcaagaaggctatcttgaacctctcgcttcgccacaaggagcacatcagtgcctacggtgaaggaaacgagagaaggttgaccggaaagcacgagacagctagtattgaccagttctcatggggcgtggctaaccgtggatgctctattcgtgtgggacgtgacaccgaggcgaaaggaaaaggttacttagaagatcgccgtccagcatctaacatggacccatacattgtgacctcacttttggcagagaccacactcctgtgggagccaactcttgaggctgaagcccttgcagctcaaaagctttctttgaatgtttaaaattagtcgaaactttcatgaatctgatgaacacacgtgtctatgtggtctctcaagttgtttaaacattcggattaagacattgtttgttgtcttttcatttgcatttttaaaactcagaattgtatggacaatgttcatccttttatattggttcttttgactgttagagcatgtccaatggttgaatttaagctggttcttaactgttg

SEQ ID NO: 500 - DNA, 3452 bp, Arabidopsis thaliana
acaagagcgtcaattcgaaaaattcaccaaacattttcggtttctcttcacaaaaaatctcaaatttctctgtgaaaatgggcgaagaatcagaaatcgccatggcttcagcagatcgaaataacctaacccagaaaatcgccaagatcctaaacgagactcgcacatcatacgctactcataaccgtaagctaaaggagctcgccacaatccgttcaaaactatcttcatctgaatccgaatccgagtccgtgtcttcttctattcttcaattctcttccgtgtttctcaaaaccctaacccctcttttcatcgcggctcaacgaagaaccgctgcagcagagcgtgttgttcgattcgtggcggaattcgcttgtcttcgtagtaattcagacggtgactccgattgcgacgagtttctagaggaatttcttaagtttttggttgctgggtctgttgctgccaatagaaacgcgagattcagggcgtgtcagataatttcagagatcatattgaggctgccagatgaagtggaagtagcggatgaactatgggatgatgtaattgattgtatgatgttgcgagttcgggacaaagttcctgttatacgtacatttgctgtgaggtctctttcacgttttgtgaatgatcctgagaatagtgacattcttgatttgctacttgaggtgcttcctttggaacagaatccggaggtacgcaaaacaattgttttatctctgcctccttcaaatgcaaccacccaagcaattattgattgcacgctcgatgttaatgaatcagtacgcaaagcagcttactctgttctggctaataaagttcctcttcagagtctgagcatcaagctaaggaccacaattcttcagagagggctcgctgatcgtgctgtaaatgtttcaacggaatgcttgaagctaatgaaagagcaatggctagctaactattgtgaaggagatcctatcacatttcttaaataccttgacgttgaaacctacgaatctgtggcagaatcggcgttggaagttctgttgagtgaagggttgataatgccctccgatgataaaagcatccagcagtacatattgtcagcagatggtgaaactagagatgaaagcacatgttctgcacccagcattcaacttatggagccagagattgctctttactggaggattatatgcaggaaggtgcaccaaagtgctcaagcaaaaggttctgatgctgctacagcgatgggtgctgaagcagcagtttatgctgctgaagcttcagatgctaatgatttgctggaaagaattcttcctgcaacagtttctgattatgttgatctagttaaagctcatatagaagcaggaccaaatcatcactttgcttcgaggcagctattattgttgggtacgatgcttgatttctctgatgctatgctccacaagactgtgagctcatttgtccaggagctgctccgcagaccttttgagcaagaattagatgaagatgggaacagtattgtgattggagatggtataaaccttggtggtgataaagattgggctgaggcagtgtcgaaattggctaaaaaagtccatgctgcccctggagaatatgaagaagttatacttgttgttgttgaagaagtagcgagaccctgcagggaaaggactgcggatttcctgcagtggatgcacatgctttctctgacaagtcttctcttggaaaatggaaaatctttacattcactgcaagggaaggctattgaaccagaagagatattgcatgctctattgcttccaggggcaaaacacactcacttggatgtgcagaggattgctataaagggccttggtctttttggtttgttagagaagaagcctagcgaagagctagtaaggcagctacgtgcagctttttgcagaagccctcctccaattagtattatggcttgcaaggcactagtggatcttgggatgtggcatagcccaactgaagttgacaaggcaatgggacaagatctcttgtcacaatttgaggatgacagcattgattttgcacccatcgacttatccaatgccgaagaagatatgaactttaaaatgctcgatctcttgtatgctggacttgaaagtgatgactggagagcatccacagagagcagtgagaatgagtcagttaaagcaactgttggggaggggtttgcaaaacttcttcttctaggagagaagtacccaaacttgcctgcatctttctatccgtttgtattgggaaagctaattgctttatatttcagtgaggagtcaaaagaacaactgaggtttaaacagtgtttatccgtcttctttgagcactatgcctccctctcagaaaaacataagggatacgtgtcaaaggcttttgttcctcttgtacgctcaatgtggcctgggattgatggaaacactaaaagttcgtcatatgttgtatcaaatcaacgcaagcgcgcagtccaagtatccagattcatcctacagatgatgcaaaccccgctatacaaaaaagagacaagaggtgagcctgaaagccaggtcaataaatcaccagaagattctatccaacatccactaaactgtacagaagaaggtttggccatacgcatagccatcgagatgctaagcttcaaagaaaagaagactgctcatgagaaggcatatgttgcagcgctgtgcaaaatacttgtgctgctccatctgaaaccatcagaacaaaatgtgacaaagttgttgaaaaagcttttaagcctactcgcagattctgtacgttcagagaaggatcttcttaaagaagtgaaaccggtgcttcaacatctaaaatctttggatgcttgtccaagcgaggagcttacacaagatcaagcaaattccatctttgaaatactcggagttagctacaacttagagatcactgaaactacaacagtgccacagacacctgctccttgctcaacaaaaccagctcggtcaagaagacgagcaaggattgaagaaacatcctctgatgaagaagaagtagcatctcctccaccttctgctcctaatactttgatgacccgatcacaccgtgcaagtaaagctgctgccttggccaaaataatggcaagcaaagtgaaaatgagcaatgtagacgaggatgatgaggaagaagaaggttcttctgatgttacagcagatgattcagatgaataactatagagagttgaattaggggttggctctgttgtttgtacgtttgctactaagtcgatgtgtgttttatgtcagttataaaaagattatagccaattcgtagcttgttatgtgtgagtgtcggttatgtttgctgtcgaaaatctttgtatttagattatagaacagataaataagaaagcacttgaatattattgaaaagactctgaagttgaatcc

SEQ ID NO: 501 - DNA, 780 bp, Arabidopsis thaliana
aaagagagacgactctgaatccaaaaaaaaaaaaaactcattaagtaaagacaaaggaagagaagaaagacgatttctcgaagaagctatggcggatcaactcactgacgaacagatctccgaattcaaggaagcttttagcctcttcgacaaagatggcgatggttgcatcacaacaaaagagctgggaacagttatgcgttcactaggacaaaacccaacagaggctgagctccaagacatgatcaacgaggttgatgcagatggaaacggcactatcgacttccccgagttcctgaacctgatggctaagaagatgaaagacactgactccgaggaagagctaaaagaagccttcagggttttcgacaaagaccagaacggtttcatctccgctgctgagctacgccatgtgatgaccaatcttggtgagaagctaactgatgaagaagtggaagagatgatccgtgaggctgatgttgatggagatggtcagattaactatgaagagtttgtcaagattatgatggctaagtgatttgataaaggtgatgatgatgatgatgatgacctttttatgcttctaggagtttaaccaaaaacatttgcatgattggtggagatatgcttttaaacagacataatttgtttttcgttcttttgattttctggtttgtgacttttgtgtgtaatggaaaatcaagtaagttggattgaaaccgatgggttgggtttttactttttacccacattttgttgcttttttggttttacaaaaaa

SEQ ID NO: 502 - DNA, 1159 bp, Arabidopsis thaliana
aaattctctatttgcctctctcagttttcgagaagactaaaagcgaatttagggtttagtcatctctccgacatggttggtgccgcgattttggaatctcccggcgaaggaattggatctaacagcattctctcgcaaaagagacaactttcttctagtgatgcagctaagagagacgctaagaaacgctcgacaatgctaatggatctggagattctcgattgtcccatttgctacgaagctttcacaattcccatcttccagtgtgataatggacatttggcttgttcttcttgctgtcccaaactaaataacaaatgccctgcgtgtacttcgcctgttggccacaatcgctgcagagcaatggagagtgttcttgaatcgatcttgatcccgtgtccgaacgccaagttaggttgcaaaaagaatgtatcttatgggaaagagttaactcatgaaaaggaatgcatgttctctcattgcgcctgccctgcattggattgcaattacactagctcatacaaggatctgtacactcactatcgtattacccatatggaaataaaccagattaatacgttcatttgtgacattcccttaagtgtccggatgaacatcagcaaaaagatattgattagaacggaacacttgacgaatcatttgtttgcagtgcagtgtttcagggagccgtatggtgtgtatgtaactgtaagctgcattgcgccatcttctccagaattaagtcagtactcatatgctctctcttacactgtcgatggacacactgtgatttaccaatcaccagaggtgaagagggttcttaagttgagttttcaaaccccgcaagagaatttcatgttgattcccaacagtttattgcgtggtgatgtgttggaaatgaggattagcgtcaagaagttgaacaaagagtaagaaggttggggtcttcctgttagaaaactcttatctgtctcgttttagttatcttaacccgcccatagtcgttatggttgatgagggttgtaattttagagacttggtgcaatcgaccaacaaaacgtttcacaatgttttcaatctaaactaagatataatttatgcataggccatttgctatgaagcattgacgattcctgtcttccaagaagatttttccatc

SEQ ID NO: 503 - DNA, 1005 bp, Arabidopsis thaliana
atggttctagttatggatgatgaagagagtaacaacgttgaaagatatgacgacgtcgtattgccagggtttaggttccatcccactgatgaagaactcgtaagtttctacttgaaacggaaggttttacacaaatctcttccctttgatctcatcaagaaagtcgacatttacaaatacgatccatgggacctcccaacgatgggggaaaaagagtggtacttttattgtcctagagacaggaaataccgcaacagcacaagacctaaccgagtaactggaggtggcttctggaaagcaaccggaacagaccggcctatatactcattggactccactcgatgcatcggtttgaagaaatcacttgtgttctaccgtggtcgagctgctaaaggagtcaaaaccgattggatgatgcatgaatttcgtctcccttctctctctgactctcatcactcatcatatcccaattacaataacaagaagcaacaccttaacaataacaacaacagcaaggagcttccttcaaacgatgcttgggcgatatgtagaatatttaagaagacaaatgcagtatcctcacaaagatcaatcccacaatcttgggtttatccaacgattcctgacaacaatcaacagtcacacaacaacaccgcaactctcttagcttcatcagacgttctcagccacatatcaacaagacaaaactttattccttctccagtcaacgaacccgcaagcttcacagaatcagctgcttcttacttcgcgtctcagatgctcggagtcacgtacaatacagccagaaacaacggaacaggggatgctctgtttctgagaaacaatggaacaggggatgctctggttctgagcaacaatgagaataactacttcaacaacttgactggagggttgactcatgaggttccgaatgtaagatcaatggtgatggaggagactacggggagtgagatgtcggcgacgtcgtattccactaacaattaa

SEQ ID NO: 504 - DNA, 1627 bp, Arabidopsis thaliana
atgccagtagtaacccgcttgattcgtttgaagtgtgtagggctcagacttgaccggagtggactcaatcggcgaatctgtcacggaggacacggggaatcaacgcggcggagagtgatggaagagctttcaagcctaaccgtgagtcagcgcgagcaatttctggtggagaacgatgtgttcgggatctataattacttcgacgccagcgacgtttctactcaaaaatacatgatggagattcagcgagataagcaattggattatctgatgaaaggcttaaggcagcttggtccgcagttttcttccttagatgctaatcgaccttggctttgttactggattcttcattcaatagctttgcttggggagactgtggatgatgaattagaaagcaatgccattgacttccttggacgctgccagggctctgaaggtggatacggtggtggtcctggccaacttccacatcttgcaactacttatgctgcagtgaatgcacttgttactttaggaggtgacaaagccctttcttcaattaatagagaaaaaatgtcttgttttttaagacggatgaaggatacaagtggaggtttcaggatgcatgatatgggagaaatggatgttcgtgcatgctacactgcaatttcggttgcaagcatcctaaatattatggatgatgaactcacccagggcctaggagattacatcttgagttgccaaacttatgaaggtggcattggaggggaacctggctccgaagctcacggtgggtatacctactgtggtttggctgctatgattttaatcaatgaggtcgaccgtttgaatttggattcattaatgaattgggctgtacatcgacaaggagtagaaatgggatttcaaggtaggacgaacaaattggtcgatggttgctacacattttggcaggcagccccttgtgttctactacaaagattatattcaaccaatgatcatgacgttcatggatcatcacatatatcagaagggacaaatgaagaacatcatgctcatgatgaagatgaccttgaagacagtgatgatgatgatgattctgatgaggacaacgatgaagattcagtgaatggtcacagaatccatcatacatccacctacattaacaggagaatgcaactggtttttgatagcctcggcttgcagagatatgtactcttgtgctctaagatccctgacggtggattcagagacaagccgaggaaaccccgtgacttctaccacacatgttactgcctgagcggcttgtctgtggctcagcacgcttggttaaaagacgaggacactcctcctttgactcgcgacattatgggtggctactcgaatctccttgaacctgttcaacttcttcacaacattgtcatggatcagtataatgaagctatcgagttcttctttaaagcagcatgacccgttgttgctaatgtatgggaaactccaaacataagagttttcgtagtgttgtaacttgtaagatttcaaaagaagtttcactaatttaaccttaaaacctgttacttttttattacgtatataccatttatcatatctttggtttacgacttaaagaatttgatgattgttgaaa

SEQ ID NO: 505 - DNA, 921 bp, Arabidopsis thaliana
atgacgattcccgttccgttagaatcgttgtttcctctacttcatcgcagtgttaactgttcctttttacccggtggtgcgattctaatctccggcgacttctccgatttcatagtcgaacaagatctttttgacaatgttggttttgaaatcgctcgtctcgtggctcgtctcgttttcttttctctatctggtgctgagatttgcttttgttatattcctgaatcagcgatgagtaaaagagctgcggaagaaatgactccttcattggagagcaatagaactggaccagacttttttggctactacagagctcaagtagaagagctcttgtctcaagaagagaagatacctcatcataaccatgtggatgctaagaagtcttctgctgagattataggagctgagttgtcggatgtcaaacaggagaagttgaatgccttgttaaggcagtgtgtgttgaattccattccagaagttgatgagatgcagtctcgtgttgattcaatgtatctgatgtctcagttgagtaataaaaaacggtcaaccttaccaaccaatgctgagtctgtgattcctgaggatcctaggtgtaaagaggtggaagatgatttacgattacttatgaagtctgatcctagtcttgttaaggaaatagtgggcaaacattcaagtgatctacttgccagattgaacgagagacagcagcaccttgagaagctacttgacaatgtgtctatcaacagacctatgagccgtggagagaagcgagatcttcagaaatcaattaaggaactacctgcaaaaaatcttgaacgtgttgctggaatcatcaaaaaccactatgtagctttggggaaagaaatgcctgatgatgttttcgtcatcaacatggaggaggaggtgggcttcttgacataa

SEQ ID NO: 506 - DNA, 1746 bp, Arabidopsis thaliana
aaaattgcagagaaagaatttgattaccgaggtagtgaagatgaggacactctggaatcactttagtaccatttcctatatcaaaatttctccgagaatgagaagaatttctgcagcaaatttgatctcaaatcgaaatctttcaaccatttcttctactgaagatcccgagctcagagattttgtgggatttttagaatctctcaaaaactatgagaaatcaggtgtaccaaaaggagctggaactgattctgatgatggattcgatctgggtcgaatgaaacgtctcatgcttcgcctccgtaatcctcattacaaatacaaggttgttcatgttgctggaactaagggaaaaggatcaacttctgcttttctctctaatatcttacgagctggaggatattctgttggttgttattctagcccacatattctgagtatcaaagaacggatttcttgtaatggagaacctgtctctgcttccactcttaatgatcttttctattcagtcaaaccgattcttgaacagtctattcaagaggaaaatggttctttgagtcattttgagattctcactgggatagccttctctttatttgaaaaggaaaatgtcgacattgcggttatagaggctgggctaggaggagctcgagacgctacaaatgtcattgaaagttcaaatcttgctgcatcggtcataacaacgataggtgaggaacacatggcagcacttgggggttccttggaaagtatagcagaggctaaatctggaattattaaacacggtcgcccagtggttttaggtggaccgtttcttcctcatatcgagggcattctccgttctaaagcagcttcagtgtcgtcatcggttattttggcatctaatattggatctagttcttcaatcaaaggcatcattaacaaaaatgggatcgggctttgccagtcctgtgacatcgtgatacagaatgagaaagatgatcaaccaattgttgagcttagtgatgtaaacctacgtatgcttggacatcaccagctccaaaatgctgttactgccacatgtgtgtctctttgtcttcgcgatcaaggatgtgggagagtgacagatgaagcaattaggattggtttagagaacactcgtttacttgggagaagtcagtttctgacaccaaaagaagcagagactttactattacccggagcaacagtgcttcttgatggagctcacaccaaagagtcagcgcgagccctcaaggagatgataaagaaggattttccagagaaaagattggtatttgtggttgccatggctagtgacaaagatcatgtgtcctttgcaaaagaacttctctcaggtctaaaaccagaagcagtgattctaacagaagctgacatcggtggaggtaagattagatcaacggagtcttcggtgttgaaagaatcatggataaaagctgctgatgaattggggtcaaggtctatggaagcttcagaaaacaaaactgtgttgggttccttaaagcttgcctacaagatactcagcgatgacacaacaagtagtgactcaggaatggttatagtcacgggttcgcttcacattgtatcttcagtcttagcttctcttcaacattaatttccttatctttacgagtctcttgtaaaaaaactcagtttgtgttaaaccaaacaaatctttttcctggaacatcatgaaccgtaacatttgatggtagttgaaaccttctg

SEQ ID NO: 507 - DNA, 949 bp, Arabidopsis thaliana
gttagatctcactggttcaatgtgtgagccgggctttaaaaacattttgatttaacccatacacacatctctctgttccacgattctcttcctcagcctccacgtcgtctctaaactcagcaaaaaccaatgtcgacggtgagaaaaatcactcttaagagttcggatggcgaaaacttcgaaattgacgaagcggtggcgctagagtcacaaaccatcaaacatatgattgaagatgactgtaccgataatggtatccctctccctaatgtcacaagcaagatcctttcgaaggtgattgagtactgtaagagacatgtcgaagctgctgagaaatccgaaaccacggccgatgctgctgctgctactactaccaccaccgtcgcgtcgggttctagtgatgaagatctcaagacttgggattctgagtttatcaaagttgatcagggcactctcttcgatcttatcctggctgctaactacttgaatatcaagggactgttggacttgacttgccagacagtggctgatatgattaaaggaaaaaccccagaagaaatccgtaagacgttcaatatcaagaacgacttcacgccagaggaagaagaagaggttcgccgtgagaatcagtgggcgtttgaatgaagaaaaatgaagacctaggttgctgtcatgtcctcgacccatttgtgtctccctgtcttatcttctttctttgactatatatccattctcttctacgtgatggtccagctaagacagtgggtcggatgttaatgttatgttatgtatgtcaaattaaagacttaactacgaaacatattgaagttgttgctcaaaagagagtgttggtcttctattgtttcgtcaatcatttagataggttgtgaacacaagtgataagatttgtctgcatgttcttagaaagagaaaagatcttattacttgt

SEQ ID NO: 508 - DNA, 1068 bp, Arabidopsis thaliana
atggccgacgaaaaagagaactgcgtgagaatgacaagagcagcaacaaaaagaaaagcttccatggaagcggcaatagacaaagaacgaatcaacaagaagagagtcgtactcggagagcttccaaacttgtccaacatcaagaaatctcgaaaagccactacaaaacagaagaagaaatcagtttcgattccgacaatcgaaaccttaaattcagacattgacacaagatctgatgatccacaaatgtgtggtccttatgttacatcaatcttcgagtatcttcgtcaattagaggtaaagtcaagacctttggttgattatatagagaagattcagaaagatgtaacttcgaatatgagaggagttttggttgattggttagtagaagttgctgaagaatacaaacttctctcagacactctttacctcgctgtttcttacattgatagattcttgtctctcaagactgttaataaacaaaggcttcagcttttgggagttacttcaatgcttattgcttcaaagtatgaagagattactcctccaaatgtggatgacttttgttatatcacagacaatacttacacgaaacaagagattgttaagatggaagctgatatacttcttgcgttgcaatttgaattaggaaaccctacaagcaacacgtttctaagacggtttacaagggttgcacaagaagatttcgaaatgtcacatttacagatggagtttctttgtagctatctttcggagttgagcatgttagactatcaatctgtgaagtttcttccgtctactgtggctgcttcagcggtgtttctcgctaggttcatcatccgtccaaaacaacatccctggaatgtgatgttggaagaatacacaagatacaaagcgggtgatttgaaagaatgtgtggctatgatacatgacttgtatctgagtagaaaatgtggagctttagaagctataagagagaaatacaagcagcataagttcaagtgtgtagcgacaatgcctgtatcaccagagctgcctcttacggtttttgaagatgtcaacatttag

SEQ ID NO: 509 - DNA, 1477 bp, Arabidopsis thaliana
atctccttatccaacaacaacaaaaaacgaattctcgaagagaaagacactgaaatcgaaaaatctatagagagctcactcactagcaatggcgtctcttctcggaagatctccttcttcaatcttgacctgccctcgtatttcttctccttcctcaacatcttcaatgtcccatctctgcttcggaccagagaaactttctggaagaatccaattcaatccaaagaagaacagatctcgttaccatgtctctgttatgaatgtcgctacagagatcaactctgttgaacaagcaaagaagattgattcaaaggaaagtgcaagacctgtttatccgtttgctgctatagttggacaagatgagatgaagctatgccttttgttaaatgtgattgacccgaagataggtggtgtgatgataatgggagatagaggaactggtaaatcaacaactgttagatctttagttgatttgcttcctgagatcactgttgtttctggtgatccgtataactcagacccgagagatcctgagtgtatgggaaaggaagtaagagagaaagttcaaaagggagaagaattgtctgttattgaaaccaaaatcaatatggttgatcttcctttgggtgctactgaagatagagtttgtggaactattgatatcgaaaaggctttaaccgaaggtgttaaggcgtttgagcctggactactagctaaagctaatagagggattctttatgttgatgaagttaatcttttggatgatcatttagttgatgttcttcttgattcagctgcatctggttggaacactgttgaaagagaagggatatcgatttctcatcctgctcggtttatcctcattggttcaggaaatcctgaagaaggagagcttagaccacagcttcttgacaggtttggtatgcacgcgcaagtagggacggttagagacgccgagctgagagttaagattgttgaagaacgagctcgtttcgatagtaacccaaaggagtttcgagaaacttatcaagaagaacaactgaagcttcaggagcagattacaactgcaagaagcaatctttctgcagttcagattgatcaagatttgaaagtgaagatctctaaggtctgtgctgagctggacgttgatggattgagaggagacatggtgataaacagagcagctagagcgcttgcagcactccaaggaagagatcaagttacagctgaagatgttggtattgttataccgaattgtttgagacacagactcagaaaagatccattggagtctatggattcgggaattctcgttaccgagaagttctatgaggttttcacttagagtaaagatagattcttgaaacacatttaaagaagattcaatctgtatcgcttattatacataaaagtttcaattttctcaatcagatcaagtcaagaatcagttaggctgattccagaaactcggtttacg

SEQ ID NO: 510 - DNA, 1088 bp, Arabidopsis thaliana
aaaaaaaaaaaactcagagcagaggagatcgagagagacaaagagagagagagagagagagagagatcttaacaaaaaaatgtctatatccatggcgttattctctccgccgatctcttcctcacttcagaaccctaatctcatccccaagatctcaacctctcttctctccaccaagcgtttctctctaatctccgtccctagagcttcctccgacaatggtacgacttcccccgtcgtggagattccgaagcctgcttctgtggctgtagaggaagttccagttaaatctccagccgaaagctcctccgcttctgaaaacggcgccgttggaggtgaagcgactgattcgagtactgagacggtaatcaaatatcagaatgcgaagtgggttaatggaacttgggatctgaaacagttcgagaaagatggcaaaactgattgggattctgttatcgtttctgaggcaaagaggagaaaatggcttgaagataacccggaaacaacgagtaacgacgagcttgttgtcttcgatacttcgattattccatggtgggcatggatgaagagataccatctacctgaagctgaacttctcaatggtcgtgctgcgatgatagggttcttcatggcttactttgttgatagtcttaccggagtaggacttgttgatcaaatgggaaatttcttctgcaaaacactcttgtttgtggctgtagctggagttctcttcatccgtaagaatgaagatttagacaaacttaaggatctgttcgatgagactacgttatatgacaaacaatggcaagctgcatggaaagagccagattcatcaacagtttcttcaaagaagtgaacaagttcttacaatctttcattttcctttttttgttatgcaataatctgtgaatcagtgaaagtttatctctactgaactactgatcttcagattttgtaatctttctgctttaaaaatctctatgaagtagtctcaaagataatgtatcgaaggtctttgacttgtaaagcagacctatttcgttttgacgcttgataatttaatcaataagagattttattttttttaa

SEQ ID NO: 511 - DNA, 2021 bp, Arabidopsis thaliana
tcacacgccggtttaagattctgtttcttttttttttttctctgtgataagagtgagacttctgttttgtctttcgagccattcccatgtgccttgtctccgacaactttctctcttcccttctctcttcctctggttcacatggaacttcaataacattcactactttaaggtttctcatctccgaaaaagtcaggtcttaaatcatcctcttcttttgatcctgttggaaaattctttgatttggtggttatgttgcttagataacctaaaaagttattgtgcagatcattgaagtgactagaaatgtacaagcagcctagacaagagcttgaggcttattattttgagcctaactctgttgagaagcttaggtacttaccggttaacaactctcgtaaacggttttgtacgctcgagccatttcctgactctcctccttataatgctctatctactgctacatatgatgatacatgtggctcttgtgtaacggatgagttgaatgacttcaaacacaagattagggaaatcgaaacggtgatgatggggccggactcgttggacttacttgtcgattgcacggactcatttgattccacggcgagtcaagagattaatggttggagatcaactctagaggctatctcgaggcgggatttaagagctgatcttgtttcatgtgccaaagctatgtcggaaaatgatcttatgatggctcattcaatgatggagaagttgcggcagatggtttcggtttctggtgagcctattcaacggttgggagcttacttattggaaggtctagtggcgcagctagcttcgtcgggcagttctatatacaaagcacttaataggtgtcctgaaccggctagcacagagcttctctcttacatgcacattctctatgaggtttgtccttacttcaagtttggatacatgtcagcaaatggtgctattgctgaggcaatgaaggaagaaaacagagttcacattattgatttccaaatcggtcaagggagtcaatgggtcactcttatccaggcttttgcagctaggcctggtgggcctccgcggattcggataacgggtatcgatgatatgacttcagcgtatgctcgtggaggtggcctaagcattgttggaaatagactcgctaagcttgctaagcagttcaacgttccattcgagtttaactcggtatcggtgtcagtttccgaggttaaacctaaaaacctcggggttcgacctggggaagctctagccgtaaactttgcctttgtgcttcatcatatgccagacgaaagcgtgagcaccgagaatcaccgcgaccggttattgagaatggtgaagagcttatctcccaaggtggtgactcttgtggaacaagagtcaaacacaaacacagccgctttcttcccgaggttcatggagacaatgaactactatgccgcgatgtttgagtcaattgatgtgactctaccaagagatcacaaacagaggattaatgtggagcaacattgtctagcaagagatgtcgtgaacatcatcgcatgtgaaggagctgatcgggtggagcgacacgagctcctaggaaaatggaggtcacggtttgggatggcgggtttcactccttacccgttgagtcccttggtgaattcaaccattaaaagtctgcttaggaactactcagacaagtacaggctagaagaaagagatggagctttgtatcttggttggatgcatcgagatttggttgcctcgtgtgcttggaaatgagacagtgacatttctctagtgtgatggcaattaatgtgtttctacttgtatgcaatttagtcgctcatttgaatcttcaaaacatttgaagaatcttatgtttactactagagaccaagagtgtgcacaattgctcaaatgtcaaagtcaactctttcctcaatcaaaatttaagtatgtagttcacacgaatggatctttgtaataatgtaatatatgaaatcaatctagtttcaataaaa

SEQ ID NO: 512 - DNA, 913 bp, Arabidopsis thaliana
cttgtatttttgaagttgaaggatcaaagaagctatggcttccaatttctggacttcgacgcactacaaagagcttaaggacccagaagaggttaatgttgttcatcctcttgatgctcagagaggaatctctgttgaagatttcagactcattaagcttcatatgtctaattatatatcgaaactggcacaacacattaagattaggcaaagagttgttgcaactgcagtaacctatatgcgtcgtgtttacacaagaaagagtttgacggaatatgagcctcggcttgttgctcctacatgcttgtatttggcttgcaaagcagaagagagtgtggtgcatgccaaacttcttgtcttctacatgaaaaaactttatgcggatgaaaagtttcgatatgagattaaagatattctggaaatggagatgaaggtcttggaagcattgaacttctatcttgttgtattccacccatatcgatctctgcctgagttcttgcaggattctggaatcaatgacactagtatgacccatctaacttggggtcttgtcaacgacacatatagaatggacctcatccttatacatccgccgtttctcataacactcgcttgcatttacattgcttctgtacacaaagagaaagacataaagacatggtttgaagagctttctgtcgacatgaacattgtgaagaatattgcaatggagatattagatttctatgaaaaccatagactgttcacggaagagagagttcacgccgccttcaacaaacttgctacaaacccataaagtttcgacttgtctgtgtgttttgttcccttgagaaaatataatgttttgccagaagttttggaaatgagattattctgtttattgtacatcagttttgctcgtcttggttcaacc

SEQ ID NO: 513 - DNA, 669 bp, Arabidopsis thaliana
atggggaaatacatgaagaaatcaaagataactggcgatatcagcgtcatggaagtctctaaagcaacagctccaagtccaggtgttcgaaccagagccgctaaaaccctagccttgaagcggcttaattcctccgccgctgattcagctctacctaacgactcttcttgctatcttcagctccgtagccgccgtctcgagaaaccctcttcgctgattgaaccgaaacagccgccgagagttcacagatcgggaattaaagagtctggttccaggtctcgcgttgactcggttaactcggttcctgtagctcagagctctaatgaagatgaatgttttgacaatttcgtgagtgtccaagtttcttgtggtgaaaacagtctcggttttgaatcaagacacagcacaagggagagcacgccttgtaactttgttgaggatatggagatcatggttacaccagggtctagcacgaggtcgatgtgcagagcaaccaaagagtacacaagggaacaagataacgtgatcccgaccactagtgaaatggaggagttctttgcatatgcagagcagcagcaacagaggctattcatggagaagtacaacttcgacattgtgaatgatatccccctcagcggacgttacgaatgggtgcaagtcaaaccatga

SEQ ID NO: 514 - DNA, 3238 bp, Arabidopsis thaliana
accgagttctgaggtttggttttagtttcaacttttcagttatccacacacatacacacatacgcttccctgaatttggtgacgttagtcttcttccttccttctcactctttgtttcgccgtgaaaatgagctctgatagatagaagcgacagagagaaacttgaagcagatgtcgtctttcttcaaatccttcgcgggaaatcccagggaagctgctgcaatggcgatggttcaatcttcatcttacagagttttgtcaggtaaaagttgttcaaatttaaggagaaacacgccgttggattcttttcttgccaagggaaggtcttccgtcaaggctttttcattcttatatgtctcacggttttcaactgaaccaaacaatgagtttggtcattcatcaaaacgaaggtctcgtgggcctgttatggcagccaagaaagcatctgaaggggaaaagcaagaagatggaaagtacaagcaaacggttgatttgccaaagactggttttggtatgagagcgaattctttgacaagggaacctgaactccagaagttgtgggaagagaaccaggtcttcaagagagtttctgataataacaatggagggagtttcattcttcatgatggtcctccttatgccaatggtgatctgcatatgggtcatgctcttaacaagatactgaaggatatcattaatcgctataagctgctccaaaactataaagttcagtacgttcctgggtgggattgccatggccttccaattgagttgaaagttctgcagtccctggatcaggaagtaagaaaggaacttacaccattaaaattaagggcaaaggcggcgaaatttgcaaaagcaacagtcaaaacacaaatggaatcatttaagcgatttggagtatgggcagactggaacaatccttatctaactcttgatccggaatatgaagcagctcagattgaagtatttggccagatggccttgaaagggtacatttatagaggtaggaaaccagttcactggagcccttcatctcggactgctcttgcagaagctgaactagagtatccggagggtcatatttccaaaagcatatatgctatttttaaattggttggtggagcgaaaacaagccttttagatgagtttatccctaatatatacttggcagtatggacaactacaccttggactatgccagccaatgctgctgtcgcggtgaatgcaaagcttcagtactctgttgtggaagtgcagtcattctcagaagatgaatcaacagtgacaagcaataaaaagaaaattcccgggaaggttctaaagaatcaacaaaagcttttcgtgattgtagcgaccgaccttgtgccagcattagaagcgaaatggggtgtgaagcttagcataagtaaaacattccttggttcagatcttgaaaactgcaggtacactcatcccattgacaacagagactgtccagtcgttatagggggtgattacataactacagaatctggaacagggttggtccacactgcccctggtcatggtcaggaggattatgcaactggcctgaagtacgggctgcctcttgtctctccggtggatgatgaaggaaagttcactgaagaagctggacagtttagagggctctctgtccttggagaagggaataccgctgttgtcagttacctggatgaaaatatgtctctggtcatggaagaatcttatgctcataaatacccatatgattggcgaactaagaaaccgacgatatttagagcgactgagcagtggtttgcatcggttgaagggtttcgcacagccacaatggatgcaatcaacaatgtaaaatgggtaccacatcaggcagtaaacagaatatctgccatgacttccagtcgatctgattggtgcatctcaagacaaaggacatggggtgtccctattcctgctttttatcatgttaagacaaaagaaccactcatgaatgaagagacaatcaaccatgttaaatctataatttcccaaaagggtagtgatgcgtggtggtatatgtcagtggaagacctacttcctgagaaatatcgtgataaagcagctgattatgaaaaggggactgatacgatggacgtctggtttgactcaggatcttcttgggctggtgtattagggaaacgcgaaggtcttagtttccctgcagacgtgtatctagaaggtacagatcagcatcgtggatggttccaaagttctttgttaacaagcatcgcaacgcaaggaaaagccccctattctgctgttataacacatggatttgtattggatgagaagggtatgaaaatgagcaagtctctaggtaacgtagtggacccacgtttggtcattgaaggagggaaaaattcaaaggacgcacctgcttacggagctgatgttatgcgtctttgggtttctagtgtagattacacaggggatgtactaataggtccccagattcttcgtcaaatgtctgatatatataggaagttaaggggaacgttaagatacctcttgggaaatcttcatgattggagagttgataatgctgttccataccaggatttacctatcattgatcagcatgctctctttcagcttgagaatgttgtaaagaatatacaagaatgttacgagaactaccagttctttaaaatattccagatcatacaacgattcacaattgttgatctgtcaaatttctacttcgatatagctaaagatagactgtatactgggggtacttcaagttttaccagaagaagctgtcaaacagttctttcaacacatcttttatccatattgagagtgattgctccaatcgtacctcacctagcggaagatgtctggcagaatcttccatttgagtacagaaatgaagatggctctgcagcagaatttgtcttcgaacttaaatggcctactttgaatgaacaatggctttcatttcctgctgaagatgttctcttctggcaaaggcttctcgaggtatcaaaactctcctaaatcaattcggaaaaactcagcaattcagcccattgtatactctctactctgcttgtaattaaagtaatagagttccttagctacttagtggagatgaactcaatgaaatcttacacaatatcagaatattcaactcgatgttatgtcaagttgatcgtgtaatcagttcttatgatatggcattatcgaaatttctctg

SEQ ID NO: 515 - DNA, 1887 bp, Arabidopsis thaliana
tcacacagactttgactgaccagtgaagactacaatgtggcgccggagcttcagtacattaccgaagaagaaatgggacgcggtggtgatcggaggtggccacaacggattaacagccgcagcttacctagcacgcggaggtctctccgtcgctgttctcgagcgccgtcatgtcatcggtggcgcggcagtgacggaggagatcgttcctggattcaaattctcacgctgcagttaccttcagggcttacttcgtccttgtatcattagagaattggagttaggtagacatggacttaagcttttgaagagaagtccttcatcgtttacaccttgtttagatggacgttatcttctgcttggacctgatcaagatcttaatcattctgagatttcaaagttctctaaacatgatgctgatgcttacccaagatacgagaagcagctagagaggttttgtggattcatggatcctcttttggattcaactccacctgaatctctgcaaagtgcctcttcttttaatgataagttgagcaacaaaatgtacaaatctgctttctgggctcgttgtctccggcaagcagtttctttggggcataaagatatggtggcttttatggatcttttattggcaccagcttcaaaagttttgaacaactggtttgagtctgatgtcctgaaggcgagtcttgcaacagatgctgtgattggatctacggccagtgtccatactccgggaagtggatatgttctcctacatcatgtgatgggagaaacagatggagagaaaggcatttggtcttacgttgaaggtgggatgggctctgtctccatggctatagccaatgctgcaaaggaagctggtgctgagattttcacaaacgcagaggtttctgaaatactaactgaagactctagcatcgtgaaaggggttttgcttgctgatggtacacgggtggagtcatcggctatattgtccaatgcgaccccttacagaacttatgtggagttggttccgaccaatgttcttcctgaaaatttcgtcagtgctattaagaactcagattacagctctgcaactaccaaaataaacttggctgttgacaagttaccacagttccagtgctgcaacacaaatcattcaggtccaggtccagagcattttggcactatacacattggtgcagagagcatggacgaggttcactcagcatgtcatgattctgaaaatggcttaccatcgagaagaccagtgatcgaaatgactattccatccacactagacaacaccatttctcccccagggaagcatgtaatcaacttgttcatccagtacactccttacaagccctcagatggaagctgggaagatcctacttaccgagaagcctttgcacaaaggtgtttcaaactgattgatgaatatgcacccgggtttagctcatccatcattagctacgacatgttgactcctccggacctggaacgggaaattggtctaacaggcggaaacatctttcacggtgccatgggattagactctctcttcctgatgcgccctgtgaaaggatggtcaaattacagaagccctttgaaaggtctctacttgtgtggcagcggagctcatcctggaggcggagttatgggtgcacctggaagaaacgctgcacatgttgttcttcaagacttgaaaagaatctagcgagtataatctcagactgtgcaatgttaactctcatgtgtaagttgtttgttactgctctgaaaacctctgtcgtagggagaggcttacagacatggacaatagttgatatcaacgaataataagcctccacgtgtagcttaacctaaatatcactaattcaacaaatatggaaagtgccc

SEQ ID NO: 516 - DNA, 2630 bp, Arabidopsis thaliana
cacggcctagctcctccgtctttacgctctctcatcaaactcgagaaaaaaaagtggcgcctctgcaatttcaattttcaaatcctaataatttttctctcgcttcccggagaacggaaccctaatttctcgacgcagacatgattttgagaactccgcagccgaagaggctcaggtccgacgccggagaaagccccttccccaccggcgctactggttccggcaatcagctaatcatctacgaagattctcctcttcctgctcctgctccgctacaaacttctcatgatcattcggcggatcaacatctttgcacctatcaatgccgccaaatggttaaagctgatgttctagatgccttgagcacagcagagaaacaagttgaggaatctaaaaccaaattacagactcttaatgccaacttcaccgaagcagatgctgaaagaaagcattttcgagataaattcttatactcagagcaagagcttgctgctgctaaagcgcgtgagaaaatgcttcaggagcagcttcttatggagatcaacaattctcaagagcggtataccaaagaactacaatcttgccatgaactggaggtaaaacttcaaaatgaaatgaaccttcgaaagaaagcggagtcttctgctgcaacagctgaggaaaaagctaaacttttggaggataaactaactcagctatctggaagtgtggacagggagaagaaacgtctcaacaatgatattgctcaactgggtaaagaagcaaagctttctgtggctaggattggtgcagatcttgaaaggatgcaatgtagggcacaaaatgctgagacggaatcaaatcttttaagatcacaactggagcatcttaaactgatatttgacgagtgtttgcaagaaaagactgaagtagacaagaagctatcgtcattcacttcggaggcagcatcttcttcagataacagtgtattggttaaacatcttcaggaagaacttaaacgctatgaagctgaagtgcgagaagctagaaagttaaaatcacggcatttagatgcggagttgttgaatgtgaacttattagaagaacaaagccgtagggagagggcagagtcagagttatcaaaatttcatgacttgcagctaagcatggaaaagttggagaatgaattgtcctcttggaagtcattgctaaatgacattcctggtgtgtcctgtcctgatgacatagttatgagattctcggtgctacagaatgaggtggttcaaagcactatgaagattggggaagcaagtacccgtattaaacaactggaggagacactggaggctatacaacttggcagacagaatgctgtaagtgaggctgcattagcgaaagagaaatctgaggctctcaaaacagacgtgaagagaattgaagtaatgctcactttggtcacggaggagaaagaacagttgaaagctgttgttaatgaattaaggaagtcaaacagtgaaggatctgtgtctggagccgcagatggagcccttattcaggggtttgaatcttctcttgcaaagaaggagaactatattaaggatttagagcaggatctaaatcaactgaaggatgtcaataatcgtcaacgtactgaaatagaacttctaaatgagaaactagttgatgaagcaaggaggaataagtcgctggaaagggatagtgatcgtcttcgctctgagatctctttactggagtcaaagctgggtcatggtgattattctgccgcaaatacaagggttttgcgcatggtgaatactcttggtgttgaaaacgaggcaaaacaaacaatagaggctttacaagctgagttacagaagacaaaagaaagacttcaagctgttgaagaattaaagagccagtctggagatgctgggaagctagttgactctcatataactggaaagattgctcaactaaaagagcaaaatgctacgcttgaaaaacgtgaagagaggtacaaaactgtttttgctgatagaatttccgtgtttagaagggcttgttgtgagctttttggttataagattgtaatggacgaacatcagcgtcccaatggaatcccagtgactcggtttactctccagtctatatatgctcaaagtgatgatgaaaaactcgagtttgaatacgagtcaggaaacaccagtattctaaacaatgagtatgcctctcagggcgacatagcgaagcagatagaaatattcatcaggaaattcaactcgattccagcttttacagccaacttaacgatggaatcattcaaccgtcggacgctatattgagagcactgcgtccttatttccaactctgtgttttgtatatttctaaagcctgctgaatagaaactgaaactcgaaagccgcagcttaaaacactggccttatctatgtctacctctggttcgttatgtctgctataattgtggtgtcagtaactctattttggtatgaaagaaactagtttcgatttactcagaaagaatatctaatgtcattctctgattatgcgtttattactttatagtcaccaaaaacagtaacacttgaatatcaagcaaacagatttttatataaccatgaatttaaaacaca

SEQ ID NO: 517 - DNA, 2172 bp, Arabidopsis thaliana
atgtccatggcgtcttcttctcttgcgacccaatcctttttttcttcctttcctctatctcaccgacttcacttccctgtaccttatcttcttcttcgttcttctttctttcgaaaaccacttagtctctctgctacttccccttcgtcatcttcttcttctccttccattttcctctcctgcttcgatgacgctttgccagataagatccaacaaccagaaaattcgacaatcaatagcgaagaaagtgaatgtgaagaagaagatgatgaagaaggagatgatttcacagacccaattcttaaattcttcaagtcacgaactttaacatcagaatcaactgcagacccagctcgagaatccaaattctccctccagaagaatcgtcgaacttcctggcatttagctccagacttcgctgaccccgaaactgaaatcgagtctaagcctgaggaatccgtctttgtgacaaaccaacaaacacttggtgtgcatattccattcgaaagtggcgtcgctagggaaatcttggaacttgctaagaatttgaaagagaatcaaactttgggagagatgttatcaggtttcgaaagaagggttagtgatacagagtgtgtagaggcattagtgatgatgggtgaatctggttttgtgaagagttgtctatatttctatgagtggatgagtttacaagaaccttcccttgcttcgcctcgtgcttgctctgtgttgtttacattgctcggtagagaaagaatggctgattacattctgcttctgctaagtaatttaccagataaggaagagtttagagatgttcgtctctacaatgccgccatttctggtctctcagcttctcaaaggtatgatgatgcttgggaagtgtatgaagctatggataagatcaatgtgtatccggacaatgttacatgtgctatattgatcacaaccttgaggaaagcaggacgaagtgcgaaagaagtttgggagatattcgagaagatgagtgagaaaggtgtgaagtggagtcaggatgttttcggtggccttgtgaagtcgttttgtgatgaagggcttaaagaagaagctcttgtgattcaaacagagatggagaagaaaggtatccgttcaaacacgattgtgtataatacgttgatggatgcttacaacaaatccaaccacatagaagaagtggaaggtctttttactgaaatgagagataaaggcttgaagccttcggctgcaacttataacattcttatggatgcttatgctagaaggatgcagcctgatatcgttgagacacttctgcgggagatggaggatttaggtttagagccaaatgtgaaatcgtacacgtgtttgattagtgcgtatgggaggacgaagaagatgagtgatatggctgctgatgctttcctgcggatgaagaaagtaggtttgaaaccttcttcacattcttacacagctcttattcatgcttactcggttagcgggtggcacgaaaaagcttatgcttcctttgaagagatgtgtaaggaggggattaaaccgtcggttgaaacatacacatcagttcttgatgcattcagacgatcaggcgacactggaaagctgatggaaatttggaaactaatgctgagagaaaaaatcaaagggacacggataacatataacactcttctcgatgggtttgccaagcaaggactctacattgaagcaagggatgttgtatctgagtttagtaaaatgggtttgcagccgagtgtcatgacttacaatatgctgatgaatgcatacgcacggggaggacaagatgcaaaactgccgcaactgttgaaggaaatggctgctcttaacttaaaacctgattccatcacatattcaacaatgatctacgcgtttgttcgtgttcgagacttcaaaagggcattcttttaccacaagatgatggttaaaagcgggcaagtaccagacccaaggtcctatgagaaacttagggcgattctggaagacaaggcaaagacaaagaacagaaaggataagactgccatacttggtataattaatagcaaattcggtcgggttaaagctaagacgaaggggaagaaagatgagttttggaagtacaagacgaatcgaactacttctcctggtcgtcaccgatcttga

SEQ ID NO: 518 - DNA, 938 bp, Arabidopsis thaliana
tagctcttctctctgcaaagctttaccacacaatagtctccttgtgtttctctttatatttgtctctataactctctttcgttaaagtttcataaaacctcaacgaactccttccatggcagcaggactatcaacaatcgccgtaacactcaaaccactcaaccgctcttctttctccgcaaaccaccctatatccaccgcagttttccctccatctctaagattcaacggcttccgacgtcgaaagattctcaccgtttgtttcgtcgtggaagaacggaaacaaagctctcccatggacgatgacaacaaaccagaaagcacgacaagctcttctgagatcttgatgacgtcgcggcttctcaagaaagcggagaagaagaaatcagagaggttcacttatttaatagcagctgtgatgtcgagctttggtatcacttctatggctataatggctgtttattaccgattttcttggcaaatgaagggaggtgaagtgtctgtgttagagatgtttggtacatttgctctttccgttggtgctgccggactgggaataacgatgtttggaatggcttacatgttcgttcacgatggacttgtgcacaagagattccctgtaggtcccattgccaacgttccttaccttcgaaaggtcgccgccgctcaccagctacaccacacagacaaattcaaaggtgtaccatatgggctgtttcttggaccaaaggaagtagaagaagtgggaggaaaagaagagttggagaaagagataagccggagaatcaaattatacaacaagggttcttctacctcttaattgctacaaacccaattttacttctttgatgtttttgtaatacattttgggactagtctttcttttagtatatataaaaaatgacgtagaagaaagagtcaggctaataaagatttag

SEQ ID NO: 519 - DNA, 1309 bp, Arabidopsis thaliana
tctgaaacagatctctcatcaatcatctcaagaaggaagaagaagatgagcagtgaaacgtcgtcgttgacgaagaagatgaagaagaagaaggaaggtttgggatggatagagtcaattaaaggatggagttgtgtgttccacgagtttctcttccagagattcatggcttctcatctacagaatccacttcctctaccttcactgaatcacctcacctgcattgtcactggctccactagtggcattggtcgcgaaaccgctaggcagcttgcagaagctggtgctcgtgttgttatggcggtgaggaatactaaagcagctcatgagctgattcagcaatggcagaaggagtggtctggtaaaggcatccctcttaatctcgaggctatggaacttgatcttctctctctggattctgtcgtcggattttgcaatctgtggaacgcgcgattatcccctttgcatgttctgattaacaatgccggcatattttccatgggagaggaacagaagttctcaaaggatggatatgagcaacacatgcaagtgaaccatttagctccagctctgctttcactactccttttgccctcacttatccgaggctccccaagcaggatcattaatgtgaattctgttatgcactatgttggtttcgttgacccggatgacatgaatgttgtttctgggaaacgaaagtttacaagcctcgttggatattctggcagcaagcttgcacaggttatgtttagcaatgtacttttgaaaaggctgcctctagaaactcgcattagcgttgtttgtttatcccccgggattgtcctaacaaatgttgcgagagatctgccgagatatgttcaagttcaatacgcgttgataccttatttcatcttttcgcctcaagaaggctctagaagcacacttttctcagctacagacgctcagattccagagcattgtgaaaagctaaaaaccgaagataagcccgtttgtacattcatatctcaaaattgcaagcacacaaagccttcagaagaagcacacaacgtagaaacagcagaaagagtatgggaaaagacgataaagctgatcggtcttcctcttgatgctgtagagaggcttatagaaggagaagaggtccaatgccggtatgggactcatcaacaataaagtctttctcacaagtctctatcttctttcctccaatttgtacttgttagatgtttctagaacttgacctcaaagctgcattacactacacagtctacactatgcacattctaaacgatcaagtattagggaatat

SEQ ID NO: 520 - DNA, 1315 bp, Arabidopsis thaliana
gaaataagtcacatgttcttcagtctcttctcatgataatataaagggcaaaagaaaaatctcacaatctttacaagagtttttaaaatctctaaccttcatggactttctcaaagtttcagacaagacaacaattccatatagaagtgattctttgtttagtttgaatcagcaacaatacaaagagtcttcttttggattcagagacatggagattcatccgcatcctactccatatgcaggaaatggacttttgggttgttattactattaccctttcacaaacgcacaattgaaggagcttgagagacaagcaatgatctacaagtacatgatcgcatctattcctgttcctttcgatctacttgtttcttcaccatcctctgcctctccttgtaacaataaaaacatcgccggagatttagagccgggaagatgccggagaacagacggaaagaaatggagatgcgcgaaagaagtcgtctctaatcacaaatactgtgagaaacacttacacagaggtcgtcctcgttcaagaaagcatgtggaacctccttattctcgccctaacaacaatggtggttctgtgaaaaacagagatctcaaaaagcttcctcaaaagttatctagtagttccatcaaagacaaaacacttgagccaatggaggtttcatcatcaatctcaaactatagagactccagaggaagtgagaaatttactgtattggcaacaacagagcaagagaacaagtatctgaatttcatagatgtatggtccgatggagtaagatcatctgaaaaacagagtacaacttcaacacctgtttcttcttccaatggcaatctctctctttactcgcttgatctctcaatgggaggaaacaacttaatgggccaagacgaaatgggcctgatacaaatgggcttaggtgtaatcgggtcgggtagtgaggatcatcacgggtatggtccttatggtgtgacttcttcactagaggagatgtcaagctggcttgctccgatgtctaccacacctggtggaccattagcggagatactgaggccgagtacgaatttggcgatctctggtgatatcgaatcgtatagcttgatggagactcccactccaagctcgtccccgtctagagtgatgaagaagatgactagttcagtgtccgacgaaagcagccaggtttaggagttatggagtttggtaataacgactttttgtttgagttttggcctttcttcaatcttgtgcctgtaaactagtactgtaaacagtcactttgattaattatggagttatattatc

SEQ ID NO: 521 - DNA, 1943 bp, Arabidopsis thaliana
attttgagatttttttccaaatattacaaaaggaaataattagattcctctttctgcttgctataccttgatagaacaatataacaatggtgtaagtcttctcgctgtattcgaaattatttggaggaggaaaatggagtgtgttggggctaggaatttcgcagcaatggcggtttcaacatttccgtcatggagttgtcgaaggaaatttccagtggttaagagatacagctataggaatattcgtttcggtttgtgtagtgtcagagctagcggcggcggaagttccggtagtgagagttgtgtagcggtgagagaagatttcgctgacgaagaagattttgtgaaagctggtggttctgagattctatttgttcaaatgcagcagaacaaagatatggatgaacagtctaagcttgttgataagttgcctcctatatcaattggtgatggtgctttggatctagtggttattggttgtggtcctgctggtttagccttggctgcagaatcagctaagcttggattaaaagttggactcattggtccagatcttccttttactaacaattacggtgtttgggaagatgaattcaatgatcttgggctgcaaaaatgtattgagcatgtttggagagagactattgtgtatctggatgatgacaagcctattaccattggccgtgcttatggaagagttagtcgacgtttgctccatgaggagcttttgaggaggtgtgtcgagtcaggtgtctcgtaccttagctcgaaagttgacagcataacagaagcttctgatggccttagacttgttgcttgtgacgacaataacgtcattccctgcaggcttgccactgttgcttctggagcagcttcgggaaagctcttgcaatacgaagttggtggacctagagtctgtgtgcaaactgcatacggcgtggaggttgaggtggaaaatagtccatatgatccagatcaaatggttttcatggattacagagattatactaacgagaaagttcggagcttagaagctgagtatccaacgtttctgtacgccatgcctatgacaaagtcaagactcttcttcgaggagacatgtttggcctcaaaagatgtcatgccctttgatttgctaaaaacgaagctcatgttaagattagatacactcggaattcgaattctaaagacttacgaagaggagtggtcctatatcccagttggtggttccttgccaaacaccgaacaaaagaatctcgcctttggtgctgccgctagcatggtacatcccgcaacaggctattcagttgtgagatctttgtctgaagctccaaaatatgcatcagtcatcgcagagatactaagagaagagactaccaaacagatcaacagtaatatttcaagacaagcttgggatactttatggccaccagaaaggaaaagacagagagcattctttctctttggtcttgcactcatagttcaattcgataccgaaggcattagaagcttcttccgtactttcttccgccttccaaaatggatgtggcaagggtttctaggatcaacattaacatcaggagatctcgttctctttgctttatacatgttcgtcatttcaccaaacaatttgagaaaaggtctcatcaatcatctcatctctgatccaaccggagcaaccatgataaaaacctatctcaaagtatgatttacttatcaactcttaggtttgtgtatatatatgttgatttatctgaataatcgatcaaagaatggtatgtgggttactaggaagttggaaacaaacatgtatagaatctaaggagtgatcgaaatggagatggaaacgaaaagaaaaaaatcagtctttgttttgtggttagtgaccgagaaatgtttaaatcaacaagagtaaaaatgttcaacacatgcttttaattttt

SEQ ID NO: 522 - DNA, 1961 bp, Arabidopsis thaliana
gagaaaaaaaagtttttttggttggaaattaattgagggagagagagagttcagaatctctaaatggctgaaacgaattgcccagaatccaggaaactctgattttagtccttttttcctcgggaaaacgtttgctttttcttttttgtgtgtgtttggttctttaattgacaaatctctctctatctgtttcatgtgctagctaaggttgtcttcactttcctctaatgagtcatgagtttcttgtcttcatcttcatctaataaagttaacaacactctcatcaatttttattatgttcaaatctgtctgacttttcgttcttttctcttacacccaagcgttttaacaatctaacatctgtctctttgaatacttagatatccaacttcaatttctctcctttctcttcccaactttgattcctgatttgggtttttgttaaagttcaagaaagttcttttttctttttttttcctcctttaatggacgaagtttctcctgcagtcgctgttccattcagaccattcactgaccctcacgccggacttagaggctattgcaacggtgtggatatctccgccggagatgaaatcaacggttcagatgagtttgatccgagatcgatgaatcagagtgagaagaaagtacttagtagaacagagagtagaagtctgtttgagttcaagtgtgttcctttatatggagtgacttcgatttgtggtagacgaccagagatggaagattctgtctcaacgattcctagattccttcaagtttcttctagttcgttgcttgatggtcgagtcactaatggatttaatcctcacttgagtgctcatttctttggtgtttacgatggccatggcggttctcaggtagcgaattattgtcgtgagaggatgcatctggctttgacggaggagatagtgaaggagaaaccggagttttgtgacggtgacacgtggcaagagaagtggaagaaggctttgttcaactcttttatgagagttgactcggagattgaaactgtggctcatgctccggaaactgttgggtctacctcggtggttgcggttgtctttccgactcacatctttgtcgcgaattgcggcgactctagggcggttttgtgtcgcggcaaaacgccactcgcgttgtcggttgatcacaaaccggatagggatgatgaagcggcgaggatagaagctgccggtgggaaagtaatccggtggaacggggctcgtgtatttggtgttctcgcaatgtcaagatccattggcgatagataccttaaaccgtcagtaattccggatccagaagtgacttcagtgcggcgagtaaaagaagatgattgtctcatcttagcaagtgatggtctttgggatgtaatgacaaacgaagaagtgtgcgatttggctcggaaacggattttactatggcataagaagaacgcgatggccggagaggctttgcttccggcggagaaaagaggagaaggaaaagatcctgcagcaatgtccgcggcagagtatttgtcgaagatggctttgcaaaaaggaagcaaagacaatataagtgtggtagtggttgatttgaagggaataaggaaattcaagagcaaatccttgaattgaaaaagaaggtttggaagaaaagtgaaaaaaaaagttttgatggtgggtaaaaattctctttagtgaaaaaagaaagataaaacaacaggtaataattacattgtaatattaatttcctgcttaaatttgttatttactttcttagtcttcccaccattatttaatctttttatatttattttactaacatgatatatataatgtacatgggaatagtgtaacttccaaacaaaaagcccccttgtatttttttttatcttggggttagttgtaataacactacattcgtctacgtaaatatttagtgttattatttgatgtttc

SEQ ID NO: 523 - DNA, 1174 bp, Arabidopsis thaliana
gaatagaaatccaaatcgtgggcaaagaaagaaacacaaaacaaaatcgtcgatggctgttacaaaaaggcttttgtgagtgtcccaattccattcacaaagttttagtgtttaataatatctgacactctctttctttgaccgtcgccgccgcaatgaccgtcggagttttagctttgcaaggttctttcaatgagcacatcgcggctctgcggcggctcggtgtccaaggcgtcgagattaggaaggctgaccagcttctcaccgtttcttctcttatcattcctggcggcgagagcaccaccatggccaaactcgccgagtatcataacttgtttccggctctacgtgagtttgttaagatggggaaacctgtttgggggacatgcgcaggtcttatattcttggcagacagagcagttggtcagaaagagggaggtcaggaattagttggtggccttgattgcaccgtacataggaacttcttcggtagccagattcaaagttttgaagctgatatcttagtacctcaactaacatctcaagaaggtgggccagagacatacaggggagtgttcatacgtgctccagctgttcttgatgtaggtcctgatgtcgaagtcctggcggattatcccgtcccatcaaacaaggtcttgtattcaagctccaccgtacaaattcaagaggaagatgctcttcctgaaacaaaagtcattgttgctgtgaagcaaggaaacttgttagcaactgcttttcatcccgagcttactgcagacactcgatggcacagttatttcataaagatgacgaaagagattgagcaaggagcttcttcaagcagtagtaagactattgtatctgttggagaaacaagtgctggtcccgagccagctaagcctgatcttcctatatttcaataactgaacagagagaagatacacacttcttaaaataaaaaccagagaaagtgtcagattctttatctttctaaagatgttttggaaaaattgcaagctagtttgcaatttgcactcaagaaagtttcacaagactctttaatggattcatgtacttgtttcttgatacaactttatatatacagttgaatctcaaacttttttgctgattcaatttggtctatgtcttgtgaaatgtgaaaggtcgtttggcc

SEQ ID NO: 524 - DNA, 1383 bp, Arabidopsis thaliana
gaagaaatgggggccataagaaaatggcagcattgactcttcatcatcatcatcatcatcgtcatcactcgtgtcttcaagcgtctggacatctgtcacgtcgtctatatcaccgaatattctcgagctttccacgaaatcccgtcaaagatctcaactttcgtctaagtcttgccgatttctcgagtttttctttatctacacgtggcactgtgtttgctgtaagagctctgagtacagtcgcggtagaagagtcgtccgagaagaagatggtgaaagggattagggtttatgagcatggcggtcctgaggttctgaaatgggaagatgtggaagtaggggaaccaaaggagggtgagatacgtgtgaagaacaaggctatcgggcttaactttattgatgtttacttcaggaaaggtgtttacaagccagcttctatgcccttcacaccaggtatggaggctgttggagaggtggtagctgttgggtcgggattgactggcagaatgatcggtgatctcgttgcttatgctggaaatccgatgggtgcgtatgctgaggaacaaatccttccagcggataaagtggttcctgttccttcatctattgatcctatcgttgcagcatcaatcatgctcaagggtatgactgcacagtttctccttcgccgttgcttcaaggtcgaacctgggcacacaatccttgttcatgctgcagctggtggagttgggtctctgttgtgtcaatgggcaaatgcgcttggagccactgtgattggaactgtctcgaccaatgagaaagcggctcaagccaaagaagatggatgccaccatgttattatgtacaagaacgaggattttgtttcccgagtcaatgacattacatcgggtaaaggagtaaatgttgtttatgactctgtgggaaaagacacctttaagggatcgttagcatgtttgaagagccgaggatacatggtgagctttggacaatcctcaggatctccagatccgattccattatctgatcttgctccaaagtcgctcttcttgacaagaccttccatgatgcattacaatgaaactcgagatgagctcttggaatgtgcaggagaggttttcgctaatgttacctccggcatcttaaaggctcgtgtgaatcacaagtacccgttgtctcgagtcgctgacgcccacgcagatcttgagaataggatcacctctggctccgttgtgctcttgccatgaaaacatatacaatgatgttagtatctttcaataagggcaatgagattcctttgtgatggaaagaatattaaatgtaccttttggacctgaatgacaatttgagaatacaaggaaacgggacccgttaatgaaacatcta

SEQ ID NO: 525 - DNA, 1249 bp, Arabidopsis thaliana
aaaccaaaaatttccaaactacccaaaccccccacaaaacatcttcgaagagaaacaaaaaaaaacaccctgaaaagaaaggaaaagagacacagagagtcagaaacttacgagtaaaaaagagcacatcttaggaaaacgataataatgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtgattgtatacatatgatatatacgtgtatgtatgtatagatgtggtggaagattaagttagatccatcaaaatctgacttttttgttctttcgttgtggcttacatgaagctttataatagcttttgtaccatatactttttagtcttttaagtttgatttttgttgtaagattaaatacgatgaaataaaagttctttttgaccgt

SEQ ID NO: 526 - DNA, 1496 bp, Arabidopsis thaliana
ctgctctcctatctcttccaatctcctctcctctctatctatccgcgtccccatttcttcttccctctaaaattccaatctttcttattgcttttttttattcaaagcttcaagattttcactagggttctttccctttctcttattcgataaattctgttcttttctttcgtattctcacggacgaacaaaccccaaggcaacgagctcatgattgagattgtggcttttgagtaaatgattcactgctcagctagagacaatggtgttggtaacccataaattgcagggttcacatgtcttgtctccttggagttcgccaacatggaccagaggcttgtgtttaaagagacctgttacgacagtgcactttgttgagaggaaagataagcatttacgattgaagcaaaaatgttgttttagtttagggtccccttgcaacggtggattgagagcaaaacctttcagagttacatcttttaaaggtggcatccaaaataatgaatcaggaggaagtgagggtgggaagaaagttactaataactctgtcaaactatcttaccgttcagatgatgacgaaaataatgtgaatggctccccaaaggcacagaacacttcgttttcatatacctcggaaacagaggattccatgacagggcaacccgctattcagaaactattcaagaaatggttgacattgttgcgcacacagtcacctattcaagtgattgacgagactttaggaggagaacaggttccacaaacgacgaagcaagaaactgaaacagaaattcggaaagcagaaagtctccagagtaccaaaaatacagtttggtcctggttttggagtctagacgcagctatcaagattccgttgctgttatttgttccagctttcctagctgtttacgcgatctgtggtgctgaagttacaaaggaattatcccctatgtgggtggttggccccttgatcatcgccctttatataaaaatgttccaaggactatgttccctttacgccttctgcttcaaccaaaccatcaaaatgataagaaacctaccatcgtattatcttgtagcataccaatacattgccgatggaaagctcaaagacgacgttaaagctctagtgtttaaaccagtggtggccatcaagaacacagactacaaagagctcacacgcacgaagctgaaacagttccaagaatggatcattgagaaatacctggattttgttgaatctgtatggccttattactgcagaactatcagattcctgaagagggctaacctgatttgaagatcttcaacatggaaccctcaaattctgacttctcagggcttctctatgatttctctctgtgctttgtttacctttttttttttttttcttaattttaggaaggcttttcatgttgtttgttcttatctctatgtatactgataccttttttgaggttttacaatgagttcttttaatattaagggttatccct

SEQ ID NO: 527 - DNA, 1317 bp, Arabidopsis thaliana
atggactttgctctcttctcctcgatttcaatctttgagataaaccacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagatacagaagaactgtaaaagcaattgtgaccaaccattatgaatcatatatatattcaatgaagcatgagcttatttcttctttaatgaagcaatgtacatttttctccaa

SEQ ID NO: 528 - DNA, 2164 bp, Arabidopsis thaliana
cagttatgaggctttaatcgaatttgttgctttgctttgcgactttcatctttccgattaatcaaatccttttatcctctgaaaaatctcaactttcgaagaaaacgaaaatggcgagccttgtctacgggacgccgtggcttagggttagatctttaccggagcttgctccagcttttctcagacggcgtcaatcttctttattttactgttctcggcgaagcttcgcggtggttgcgtgttccactccagtcaacaatggtgggtctgtcagagttcgtttcgcgccttctcctactggtaatctccatgtaggtggagcaaggactgctcttttcaactacttgttcgcgaggtctaaaggagggaaatttgtgctgagaattgaagatacagatttggagagatcaacacgtgaatctgaagcagctgttcttcaggatctctcatggcttggtcttgattgggatgaaggtcctggggttagtggagactttggtccttatcggcaatctgaaagaaatgctttgtataaacaatatgcagagaagcttttagagtcaggtcatgtctatcgatgcttttgctcaagtgaggaacttgtaaagatgaaggagaatgcaaagttgaaacagttgcctccagtatataccgggaaatgggcaacagcttctgatgctgaaatagagcaagagttagaaaagggaacaccttttacttaccggtttcgtgtgccaaaggaaggctctttgaaaattaatgacctgattcgtggcgaggtctgttggaacttggatactcttggggattttgtggtaatgagaagtaatggccaacccgtttacaacttttgtgttacggtagatgatgctaccatggctatatcacatgttataagggctgaagaacacttgcctaatactttgaggcaggctctaatttacaaggctcttaagttcccgatgcctcaatttgcacatgtttctttaattttagctccggatagaagtaaattatcaaagcgacatggggcaacttctgtaggccagtacagagagatgggatatctacctcagggaatggttaactatttggcactcttaggttggggagacgggactgaaaatgaattcttcacactcgaggatcttgttgaaaaattctcgattgaacgtgtcaacaaaagtggcgcgatttttgattcaacaaagttaagatggatgaatggtcaacatctgagggcacttccaaatgagaaactaacaaaacttgttggtgagcgatggaagagcgctggtatcttaacagaatccgaggggagttttgtaaatgaagctgtcgagcttctcaaggatgggattgagttggtgacagattcagacaaagtacttttgaacttgctttcatatcctctacacgctacattggctagccctgaagctaagcctgctgtggaagacaaacttcatgaagtagcagccagcctcatagctgcttatgacagcggagagattccaagcgctttagaagaaggacaaggtgcttggcagaaatgggtgaaagcctttggcaaatccttgaaacgcaaaggtaaatcacttttcatgccactacgagtgttgttaacgggaaaactccatggtcctgagatgggcaccagtattgttctgatttacaaagctggaagtcctggtatagtggttcctcaagctgggtttgtgtccatggaggaacggtttaagattcttagggagatagactgggaagctttgaacaaagatgagagtgtgcctcttgaatctacagccacagtatcaacctgagaaaactcccctttttttttttttttttttttccttcaatatttggttagttggtgagagaaagacagcccagagattttgattcctcgtgcatttcttgtttcccgaaacaaatggcacaaagaaatttgtagattataatgtatcagcaaagcaaacttaggaacaaaccagagagcttgtaacattatcaggccagttttaatttgctttcaatgctctgttttcttaacattttcttctttgtctgttttttttttggtcattttttttcttatttgtttaactgtactttctctctaaggataaaatcttataatggtaaaagctctcttttgttc

SEQ ID NO: 529 - DNA, 1274 bp, Arabidopsis thaliana
ggaagagtgacaccggggctagcgcgtgacgagcgatgggagatgacgaagcgcgtagttggattcgcggagacgagacggcgaagcagatgttatcaagggttcttaaggaccgtgcgttcctgcttattccgccacttcaccgtgtacctttacgcgccgggaacgtagtcgagatcaccggcgcatctacgtcagcgaaaactcaaatcctgattcaagctgcgatcagttgcattcttcctaaaacgtggaacggcattcactatggaggattagggaaactggttttgtttctcgatttggattgtcgctttgatgttctccggttatctcaaatgctcaagcatcgtcttcttcaagctaactggttaggaaatggagcatggtggcaacttgaggagtcaaatgttaagagttgcaaatctgcagaagagaagacaaagactgtgtttgatgaggagttatatgcttcatgcatgaaaaggtttctgtatgttcgttgctatgatagtcttgaactattgtccagtctcaagtatttcactgtgttgcagacattgcattaccggatccaacaacaggaggcgtgtggaagtcaagtcggagtgcttatgattgacagcattggtgcttttcactggactgatcgtctatcatcatcattggcattggagacacataacaggaagagtttgtcccttacgaatgtggtggagacgatagtgcaagagttgaagaagctcctgctggtacattcgctggtagtacttgccactaagggtacaatttacgaagaaaagtacccagcaaatgagaataatcggtctcctcaaacgaccatttttcagggaatgttgcaagtaaagctcagcaacctccatttcgtgaattcatgccttcttcttggcaggcatttgtaacacataagatcatcatacgaaaatcagctgattatcagtctttacaaacgggacaacaaaatttgttggcatattcacttgaatggttacaaccgcaacttagtagaatagaccgcttcatagtagacgatgtaaggaaacttacgaccataaaaccattttactctaaactattactcatatatattgttattcctgcttcatcatctcatgcagtctggtattgtcattgtctcgtgacctagagatttcatttcaggtattcttcaatatctatctttgagagactcacacatgtttggaagtatgtagaaaccataaactattgtgaatgaaaagttagctattagc

SEQ ID NO: 530 - DNA, 835 bp, Arabidopsis thaliana
agggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgct

SEQ ID NO: 531 - DNA, 950 bp, Arabidopsis thaliana
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttgtgccttaacattgtggagagagaccagcatagaatcactctgttctttacagttggtattgcactagaaagtccacgacgtggttctaaacttgatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgttaccttcggagacaggatgatatagtatttactttcgtgct

SEQ ID NO: 532 - DNA, 615 bp, Arabidopsis thaliana
atgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagagtcgtttacgtctcttggaaacgcaagaattttacaatctttctttcatggcaggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaa

SEQ ID NO: 533 - DNA, 4074 bp, Arabidopsis thaliana
gaatgagaagaggcaattaaaaatctcccgtgactctcgtctccccatctctctctctccctctgcccaaatttctggggcaaatttgttcatcagatctactacaatctctctttttcttcgggtatggagggccaacgaggcagtaattcttcgttgagctctggcaatggcaccgaagtcgccaccgacgtttcttcttgcttctatgttcccaatccctctggaaccgatttcgatgccgagtcgtcttctcttcctcctctctccccagctcctcaagtggcattgtcaattcctgcggagcttgccgccgccattcccctcatcgatcgcttccaggttgaagcttttctgcggctaatgcagaaacaaatccagtctgctgggaagcgtggcttcttctattccaaaaagtcctctggctccaatgtccgcgagcgcttcacatttgaggatatgctttgctttcaaaaggatccaatccccacatctctcctcaagattaacagcgatctcgtcagccgtgctaccaagttgtttcatctcatcttaaaatatatgggtgttgattcatctgatcgatctacgcctcccagtttagatgaacgcattgacctcgttggaaagctcttcaaaaaaactttgaagcgtgttgaactcagggacgaactttttgcccaaatctccaaacagactagacataatcctgacaggcaatacttgatcaaagcttgggaattgatgtacttatgtgcctcctctatgcctcctagcaaagatatcggtggatatctatctgagtatattcataatgtcgcacacgatgcaactattgaaccggatgctcaggttcttgctgttaacactttgaaagctttaaagcgctctatcaaagctggtcctaggcacaccacacctggtcgtgaagaaattgaagcccttttgaccggtagaaagctcacaaccattgtcttctttctcgatgaaacttttgaagaaatttcatatgacatggctaccacagtgtctgatgctgttgagctagctggaacaattaaactatcagctttctctagctttagtttgtttgaatgtcgtaaagttgtttcaagttctaaatcatctgatcccggaaatgaggaatatataggattggatgataacaagtatattggagatctcctcgcagaatttaaagctattaaagatcgaaataaaggagagatactacactgcaaactggtatttaaaaaaaaattattccgagagtctgatgaagctgtaacagatctgatgtttgtgcaactttcgtatgttcaactgcaacatgactatttgctaggaaactatcctgttgggagggacgatgctgcacagctttgtgccttgcaaattcttgttgggattgggtttgtcaatagtccagagtcatgcattgattggacatcacttcttgagcggtttttgccaagacaaatagcaataacccgagcaaagcgtgaatgggaattggatatccttgctcgctaccgttcaatggagaacgtgaccaaagatgatgcaagacaacaatttctacggatactgaaggcactgccatacgggaattcagttttttttagcgtacgcaagatagatgatccgatcggtcttttacctgggcgaatcattttgggtatcaacaaacgtggggttcacttttttcgaccggttcctaaagaatatctgcactctgctgaactacgtgacatcatgcaatttggcagcagtaacactgctgtctttttcaaaatgagagtcgctggtgttcttcacatatttcagttcgagacaaaacagggagaagaaatttgtgttgctttgcaaacacatataaatgatgtcatgttgcgtcgttactccaaagctcgatctgctgccaatagcttggttaatggagatatatcttgtagttctaagccgcaaaattttgaagtgtatgaaaaacgtttgcaagatttgtctaaggcttatgaagagtcccaaaagaagattgagaagttgatggatgaacaacaagagaaaaatcagcaagaagttactctgcgtgaagagttagaagctatacacaatggtttggagcttgaaaggagaaaattgttggaggttactttagaccgagataaacttaggtcattgtgtgacgagaagggaacaactattcaatccttgatgtctgaactgcgaggaatggaagcaaggttggcaaagtcgggcaacacaaaatcaagtaaagagacaaaatcagaattagccgaaatgaataatcagatattatacaagatccaaaaggagttagaagttcgaaataaggaattgcatgtcgcagttgataattcaaagaggttgttgagtgaaaacaagatattggagcaaaatctcaatattgaaaagaagaaaaaagaggaggttgaaattcatcaaaagagatatgaacaagaaaaaaaggtgttaaagcttcgagtttctgaacttgaaaataagcttgaagtacttgctcaagacttggatagtgctgagtctacgattgaaagtaagaattctgacatgctgctgttgcaaaataacttgaaagaacttgaggagttaagagaaatgaaagaggacattgacagaaaaaatgagcaaacagctgccattttgaaaatgcaaggagcccaacttgctgagctagaaatactttataaggaagaacaagttttaaggaaaagatactataataccatagaagatatgaaagggaagattagagtttattgtcgaataagacctctaaatgaaaaagagagttcagagagggaaaaacaaatgctgacaactgtggatgagtttactgttgaacatccatggaaagacgacaaaagaaagcaacacatatatgatcgcgtatttgacatgcgtgctagtcaagatgatatctttgaagacacaaagtatttggtacagtcggctgtagatgggtataacgtttgcatctttgcatatggtcaaactggttctggaaaaactttcactatatatgggcatgagagcaatcctggactcacacctcgagctacaaaggaactgttcaacatattaaagcgagatagcaagagattttcattttctctaaaggcatatatggtggaactttatcaagacacacttgtagaccttttgttaccaaaaagtgcaagacgcttgaaactagagattaaaaaagattcaaagggaatggtctttgtagagaatgtgacaactattcctatatcaactttggaggaactgcgaatgattcttgaacggggatcggaacgacgacatgtttctggaacaaatatgaatgaagaaagctcaagatctcacctcatattatcagttgttattgaaagtattgatcttcaaacccagtctgctgcgaggggcaagctgagttttgtggatcttgctggttctgagagagttaaaaagtcgggctcagctggttgtcaactcaaagaagctcaaagtatcaacaaatcactttctgcattaggtgatgttattggtgctttatcttctggcaaccagcatattccttataggaatcacaagctaacgatgttgatgagcgattcattgggcggcaatgccaagacgttaatgtttgttaatgtgtctccagccgaatcaaatttggacgagacgtacaattctcttctatatgcatcgagagtgagaacgatcgtgaatgatcccagcaaacatatatcatccaaagagatggtgcgattgaagaagttggtagcatactggaaagagcaagccggtaaaaaaggtgaggaagaagacttggtggatattgaggaagatcgtacacgaaaagatgaggcagatagttgaagaaagctgacatgaaattcgtctaggtgaaattgagactatagtatcactggttttcaccattctttttgtaggaagttcctgctttatagtagagtttctatcgaagagtagtcctatatgtctcaaactttctctcttttgatgagatcttcattacaagaaatg

SEQ ID NO: 534 - DNA, 1686 bp, Arabidopsis thaliana
aaagctccgttattcaagattattccgataatgcagtcactctccaccccacacaccatctctcttcttctccccagaacctctccgtctcgtctttctccctctcttcactcccttgctttccccactcgattacggtctctttcctattcttctcaaacgtcgatcctccccgatgccggcgatgatttcattgtcggtgactgtctcgtctacgaggacggcgtcttcgaagacccttaccttgataaggaggtcactcaggttgcgaagcaggagcgcaagaagaatcggcgtggcggggctaagagattagatgaatccgagattgagcccgagaacctcgtgccagaggaatggagggatattcaggcggaggtgaatctgacgaagaaggacaagcgcaaaatagcgcaggagatggagttcggggttcgggtggagaagaagaggcaagggctaattccgctgaggaaagttgacttgaatgactttctcacgtacaaggaagccaagttggctcaattgaggcctgtcattctcgataaaccgggaaatttctccgacgacagtggagcgtcaagcgatggagagaccgctgtatcatctcccagcgagcgagtggctcctaagaaccctagatgggcagtttacggaaagggattcgaccacgttgccaagttcttcaatagcgacaagtacgatcccagcgacaagaaatccgacggccctcgaaagctgctttcaaaagaagagaagtttatgctcaatagccggaatcctgacctagccgttgccacatcaaaaaaatggcttcctcttcacacactggcagcatgtggagagttttatctggttgattccttgctaaagcacaatcttgatatcaatgcaaccgatgtgggcggcttgacagtacttcaccgagcaatcattggtaagaagcaggctattactaactacctgctgagggaatcggcaaatccatttgttcttgatgacgaaggtgcgaccttgatgcactatgctgtgcaaacagcatcagctcccacaataaaacttctcctactgtataacgctgatataaacgctcaggacagggtaggatgatgtcaagcattcattgtaagacaacatcattgttgatcaggtggttgacaatttggcactgggttttcaggacgggtggactccactgcacgttgcagtacaggccagaagaagcgacattgtaaagcttcttttgataaaaggggcggacatagaagtgaagaacaaggatgggttaactccgcttgggctttgcctctaccttggaagagagataaggacgtatgaggtgatgaagctgttgaaagagtttccacttagcagacacaagaagagattggtaacaacagatgaagatattgaatagtcctttcaatttcagcttgaagtacactcacttatgagaacctgagaaaaggagatggaggtaaaggtgatgattagggcattggaacctcggagtcggagtgggtccactgtctcacttccttaaatttggtttgctgttagtcttatccatcgattttggatatttatcacaacttgatccattcttaaagaaaatatctgaaaataaataaaaagtaatacatatatatatatatatatattatttataacagtctgtgaatggat

SEQ ID NO: 535 - DNA, 1244 bp, Arabidopsis thaliana
atctcagcccttttgattattactctttagtctttactttgctcacagctttggatcaccaaaaaaaaaactcaagagagactttgtggccatggcagcctctctccaatccaccgctacattcctccagtcggcgaagatcgccaccgctccttctcgcggaagttctcacctccgatcgactcaagccgtcggcaaatcttttgggctcgaaacttcctcggctcgcctcacttgctccttccagtctgactttaaggacttcaccggtaaatgctccgacgctgtcaaaatcgccggattcgctcttgccacctctgctctcgtcgtctcgggagcaagtgcggagggagctccaaagagattgacctatgatgagattcagagcaagacatacatggaagtgaaaggaactggaacggctaaccagtgccctactattgacggtggctctgagactttctcgttcaaacccggaaagtatgcaggaaagaagttctgcttcgagcctacttccttcaccgtcaaggcagacagtgtaagcaagaacgctcctccagagttccagaacacaaagctcatgacccgtcttacctacacccttgacgagatcgaaggacccttcgaggttgcttcagacggaagcgtcaatttcaaggaagaagatggaatcgactatgctgcagtcacagtccaacttccaggaggtgaacgtgtgccattccttttcacagtcaaacagcttgacgcctcaggcaaaccagacagcttcaccggaaaattcttggttccatcgtaccgtggctcttccttcttggacccaaagggccgtggtggatccacaggatatgacaacgccgtggcattgccagctggaggcagaggagacgaggaggagcttgtaaaggagaacgtgaagaacactgccgcttcagtgggagagatcactctgaaagtgacaaagagcaagccggagacaggagaggtgatcggagtgttcgagagtcttcagccgtcggatactgacttgggtgctaaggtaccaaaggatgtgaagatccaaggggtgtggtatggtcaacttgagtgatcatgttattatattttccgttgattgtgtttgatgataatgataacatcttttgatgctttcttcgtttatctctcttatataaaatgcacatgcctaagatcttgaattttctgtatatccatgtccttcatcgtaaaaacagtaccgattt

SEQ ID NO: 536 - DNA, 2377 bp, Arabidopsis thaliana
atttgcctccttcttcttcaaaccaatttcttcttcttcttctctcaggtttgagtctgaggcatcacaacagataaagtcttgaactttgatcaagaattctaaacggagtttttgctcttctcgtcggtgaaagaaaaatcgagatgggttcaactccgttttgctactctatcaatccatctccatcaaagcttgatttcacgaggacccatgtgtttagtcctgtttctaaacagttttacttagatttatcatcgttttccggaaaacccggaggagtatctgggtttaggagccgtcgagctttgctcggagtaaaggcggcgacggcgttagttgagaaggaggagaagagagaggcggtgacggagaagaagaagaaatcgagggttttagttgccggaggtggaatcggaggattggtgtttgctttagcggctaagaagaaaggattcgatgtgttagtgtttgagaaagatttgagtgctataagaggagaaggaaaatacagaggcccgattcaaatacagagcaacgctttagctgctttggaagctattgatattgaagttgctgaacaagttatggaagctgggtgtatcactggtgatcggattaacggtctcgttgatggtatctctggtacttggtatgtaaagtttgatactttcactcctgcggcgtcacggggacttcctgtgactagagtaattagtagaatgactctgcagcagattctagcacgtgcggttggagaagatgtgattagaaacgagagtaatgttgttgattttgaagattctggagataaggttactgtggtactcgagaatggtcaacgctatgaaggtgatctgcttgtgggtgcagatggcatttggtctaaggtgagaaataatttgtttggccgtagtgaagctacttattcaggctacacttgttacacggggattgcagattttataccagcggatatcgagtctgttggctaccgggttttcttgggacacaaacagtactttgtttcttcggatgttggtggtggaaaaatgcaatggtatgcatttcacgaggaaccagctggtggggctgatgctccaaatggtatgaagaaaaggttgtttgaaatatttgacggttggtgcgacaatgtactcgacttgttgcatgcgactgaggaggaagccattctgagaagagatatttatgatagaagtcctggttttacttggggtaaagggcgtgttacgctgctcggggattctatccatgcgatgcagccaaatatgggtcaaggtggatgcatggccattgaggatagttttcaactagcattggagcttgatgaagcatggaaacagagtgttgaaacgactacacctgttgatgttgtttcctctttgaaaagatatgaggaatctagaagactgagagtcgctattatccatgcaatggcgaggatggctgcaattatggcttccacttacaaagcatacttaggtgttgggcttggtcctctgtctttcttgacaaagtttagagtaccacatccaggaagagttggtggtagattcttcgttgacattgctatgccatcgatgcttgactgggtccttggaggtaacagtgaaaaactccaaggaaggccacctagttgcagactcactgacaaagccgatgaccggcttcgagagtggtttgaagatgacgatgctcttgaacgtactataaagggagaatggtatctaattccacacggcgacgattgttgcgtttcggaaacattatgtctaaccaaagatgaagatcaaccttgcatcgtcggaagcgaaccagatcaagattttcctggaatgcgcattgtgatcccttcgtctcaggtatataaactgtatgcatgctcgtgtgatttacaaagacggagctttcttcttgatggatcttcgaagcgaacacggaacctatgtgaccgataacgaaggaagaagatatagagcaacaccgaattttcccgcgcggtttagatcgtccgacatcatcgagtttggttcagataagaaggcggcgtttagggtgaaagtaatcaggaaaactccgaaatcgacgaggaagaatgagagtaacaacgataaattacttcagacagcttgaaataagtaaaccgatggtgaaattaagtaattttaatcggtttggcagataatttgagtagtaattttctcaaaagaaaaaaaatctgctttcagctattccttgcatgacaatgtatatataggtctgaaacaaaatataaattatacaagacattaatcttcatttcttcaacttccaggcaacaataatctaattttgattactaaaaggtaattatatt

SEQ ID NO: 537 - DNA, 1544 bp, Arabidopsis thaliana
aggagaccaaaaactaggagacagtctaatacacttgtattgggaaagaatcaattttcaaaatgaatttcttcataaatatttttttttcctttgactcctttcattgataaaaaaaaatcctgcacctctctaatgatgaatacttgaatagagtcagatatttattctattaaataatttagttatttatttagaacctacctttatttgctttgatggttattctcatctgagttttcttcttctctcttatttctctcccaagtttcttattttttttcctctttactttacacaaaggaacaacaaataatgtggaaccttaacgactcacccgatcatcacgaagaatccgacagtagagggaatccggtcggacacgtgtcaaacgggatgagtcaatctgcaacgtggctaccgtttgtgcttccggtgaccaggaatttctttccggctcaaagcatggaaccgggagttcgttggtccggtttcaatagtgtcggtaagtcggatccaagcggatcgggtcgaccagaagagccggagatatcaccgccgataaagaagagccgacgtggtcctcgctcacgtagctctcagtatcgaggagttacgttttaccgacgaaccggaagatgggagtcacatatttgggactgtgggaagcaagtgtacttaggtggatttgacactgcacatgctgctgctcgagcctatgatcgagcggcgattaaattcagaggtgtagatgcagatattaatttcgacattgaagactaccttgacgatttgaaacagatgggaaatttgacaaaggaagagtttatgcatgtacttagaaggcaaagcactgggtttccaagaggcagttctaaatacagaggtgttactttgcacaaatgtggaagatgggagtcacgtttgggtcaattcctcaacaaaaagtacgtttatttgggtctctttgataccgagattgaagctgctagagcttatgataaagcggcaataaagtgtaatgggaaagacgctgttaccaattttgaccctaaagtatacgaggaagaagaagatcttagctcagagacgacgaggaacggtcataatcttggtctaagtctaggagaatcatcatctgaagagtttagactcaagtctgatattgcaagcataagaagtaggattagagatgaggagagattattagggagcgatctatcgctagcaatgatgacgacgactgtcagatcggaaaagcagcaatcggacggtggaggaaatcgagtggtgggaatggcagcatcatcaggattctctcctcaaccttccccttaccgcattcctcgcaccttccacttctctcgtccctgattcatcatcatcatcatcactatcatcacaatcatcatctgagctagtgttaaccaagttatgctttaatgaatttgagttattctcgagctatttttgggctctgtaatacatatatgttcttgagtacggtataacaagtttttttctttctgttaatttaatcagac

SEQ ID NO: 538 - DNA, 1415 bp, Arabidopsis thaliana
aaggcgtgagataataaaaccctttggctttctcatagagatttgtccggtctcttgttcctctttctcctttcttcactgtagaatccgtcgaccaaacaactagctccaatggcataatgagcattgtagtttgcaatttcttcttccgtgaagaagaagaagatggctttggagaaagaggaagaagcgtcacaaaacggtgcgttttgtgtccttgatgggctctattgcgaggaagaaaccgggtttgtggaggacgatcttgatgacgatggagatttagattttctcgagaaatctgatgagagtgttgtaaagtttcagtttttacctcttttggatatgttcttatgggatgacgatgagattctgagtttgatttcaaaggaaaacgaaacgaatccatgttttggggaacaaatcttagatggctttttggtttcttgtaggaaagaggctttagattgggttcttagggttaaatctcattatgggtttacttcattgacggctatacttgctgtgaactacttcgataggtttatgacaagtataaagcttcagactgataagccatggatgtctcagcttgttgctgtggcttctttgtctttagctgctaaagttgaagagattcaagttccattgctcttagacctccaagtggaagaagcaagatatctctttgaagctaagacgattcaaagaatggagcttttgattctttctactcttcaatggagaatgcaccctgtgactccaatctctttctttgatcacattatccggcgatttggctctaaatggcaccagcaattagacttctgtaggaagtgtgagcgtcttctgatctctgttattgctgatacgaggtttatgaggtacttcccttctgtcttagctactgcaataatgatccttgtcttcgaggaattgaagccatgtgatgaagttgaataccaatctcaaataacgactctactcaaagtcaatcaggagaaagtaaatgaatgctatgaactgttgttggagcacaatccaagcaagaagaggatgatgaatttggttgatcaggacagtccaagtggtgtattagactttgatgacagctcaaatagctcctggaatgtctccactactgcttcagtgtcctcatcatcttcgtctccagagcctctgctcaagagaagaagagttcaggagcagcaaatgagattgccctcaataaaccgtatgtttctcgatgtgcttagtagtcctcgctagtacctttctttgatcaaatgtgtcaaaacataaattcaatctctcttttgcttattattatcggccatcggctacaatttgaaggcagaacattttgtgataactctaagttaattctgcctcttaaatcataatattcattgatc

SEQ ID NO: 539 - DNA, 1863 bp, Arabidopsis thaliana
acttgcactatcctcctcttcgcaacaatggatgcttcggtggtgagattttcccaatcgccggcaagagtgccaccggaatttgaaccagatatggagaagattaaacggaggctgctcaagtacggtgttgatccaacccccaaaatcctgaacaatctccgaaagaaagaaattcaaaaacacaaccgtagaaccaagcgcgaaaccgagtccgaggcggaggtgtatacggaggcgcagaaacaatcaatggaggaagaagctcgttttcaaacccttagacgggaatacaagcaattcacgaggtcaatttctggaaaaaggggcggcgatgttggtttgatggttgggaatccatgggaaggaatcgagagagtgaagctgaaggagctcgttagtggcgttcggagagaagaggttagtgctggtgaattgaagaaagagaatctaaaagagttgaagaagatacttgagaaggatcttcgttgggttctagacgacgacgttgatgtggaagaatttgatttggacaaagaatttgatcctgcgaaacggtggcgtaacgaaggagaagcagtcagagttctcgttgacagattgagtggtagagaaatcaatgagaagcattggaagtttgtgagaatgatgaatcaatcagggcttcagttcactgaagatcagatgcttaagatcgttgatcgattgggacgtaaacagagctggaaacaagcttcagctgttgttcattgggtgtattctgataaaaagcgtaaacatcttaggagcagatttgtttacaccaagcttttgtccgttcttgggtttgcgaggaggccacaggaagctcttcagatattcaatcagatgcttggtgatcgccagttatatcctgatatggcggcgtaccactgtattgctgtaacacttgggcaagcgggtttattgaaggagttgcttaaagtaatcgagcgtatgaggcagaaaccgactaaactaactaagaatttgcggcaaaagaactgggatcctgtgcttgaacctgacttggttgtatacaacgctattcttaacgcttgtgttccaacactccaatggaaggctgtttcatgggtatttgtagagttaagaaaaaatggtttgaggcctaatggagctacatatgggcttgcgatggaggttatgctggagtcagggaagtttgatcgtgttcacgatttttttaggaagatgaaaagcagtggcgaagctccaaaagcaatcacatacaaggttcttgtccgagctctctggagagaaggcaagatcgaagaagctgttgaagcagtcagagatatggaacaaaagggagttataggaacgggttcagtttactatgaattggcatgctgtctgtgcaacaacgggcgttggtgcgatgcaatgctcgaagtggggaggatgaaaagacttgaaaattgcaggccgctcgagattaccttcacaggactcatagccgcttcattgaacggtggtcatgttgatgattgcatggctatattccaatatatgaaagataaatgtgatccgaatataggaactgcgaacatgatgcttaaagtttacggaaggaatgatatgttttcagaagctaaagaattgtttgaagagattgtcagcagaaaagagactcatttagttccaaacgagtatacatacagcttcatgcttgaagcttcagctagatcactgcaatgggaatactttgaacatgtgtatcaaacgatggttctttctggttaccaaatggatcaaacaaaacatgcatcaatgctgatagaagcatcaagagccgggaaggtaacaaatctttgtctagtttaa

SEQ ID NO: 540 - protein, 429 aa, Arabidopsis thaliana
MEDQVGFGFRPNDEELVGHYLRNKIEGNTSRDVEVAISEVNICSYDPWNLRFQSKYKSRDAMWYFFSRRENNKGNRQSRTTVSGKWKLTGESVEVKDQWGFCSEGFRGKIGHKRVLVFLDGRYPDKTKSDWVIHEFHYDLLPEHQRTYVICRLEYKGDDADILSAYAIDPTPAFVPNMTSSAGSVVNQSRQRNSGSYNTYSEYDSANHGQQFNENSNIMQQQPLQGSFNPLLEYDFANHGGQWLSDYIDLQQQVPYLAPYENESEMIWKHVIEENFEFLVDERTSMQQHYSDHRPKKPVSGVLPDDSSDTETGSMIFEDTSSSTDSVGSSDEPGHTRIDDIPSLNIIEPLHNYKAQEQPKQQSKEKVISSQKSECEWKMAEDSIKIPPSTNTVKQSWIVLENAQWNYLKNMIIGVLLFISVISWIILVG

SEQ ID NO: 541 - protein, 333 aa, Arabidopsis thaliana
MLDYEWDNPSSIVLSGDERNPDSDPTRSSFSFFDPISHYNNDHRHITISPPLLSSFSNQQQQHHLTLYGQTNSNNQFLHHHHHHHSLYGSTTTTTPYGASDPIYHPHSSAPPASLFSYDQTGPGSGSGSSYNFLIPKTEVDFTSNRIGLNLGGRTYFSAADDDFVSRLYRRSRPGESGMANSLSTPRCQAEGCNADLSHAKHYHRRHKVCEFHSKASTVVAAGLSQRFCQQCSRFHLLSEFDNGKRSCRKRLADHNRRRRKCHQSASATQDTGTGKTTPKSPNDSGVKASSSPSSNAPPTISLECFRQRQFQTTASSSTSASSSSNSMFFSSG

SEQ ID NO: 542 - protein, 501 aa, Arabidopsis thaliana
MALYLSSSRLITFLSFILLLSNGFSSSSSRPSIHHRHHLDNHNYKDALSKSILFFEGQRSGKLPPNQRMTWRSNSGLSDGSALNVDLVGGYYDAGDNMKFGFPMAFTTTMLSWSLIEFGGLMKSELPNAKDAIRWATDFLLKATSHPDTIYVQVGDPNMDHACWERPEDMDTPRSVFKVDKNNPGSDIAGEIAAALAAASIVFRKCDPSYSNHLLQRAITVFTFADKYRGPYSAGLAPEVCPFYCSYSGYQDELLWGAAWLQKATNNPTYLNYIKANGQILGADEFDNMFSWDNKHVGARILLSKEFLIQKVKSLEEYKEHADSFICSVLPGASSSQYTPGGLLFKMGESNMQYVTSTSFLLLTYAKYLTSARTVAYCGGSVVTPARLRSIAKKQVDYLLGGNPLKMSYMVGYGLKYPRRIHHRGSSLPSVAVHPTRIQCHDGFSLFTSQSPNPNDLVGAVVGGPDQNDQFPDERSDYGRSEPATYINAPLVGALAYLARS

SEQ ID NO: 543 - protein, 182 aa, Arabidopsis thaliana
MAQHQHSPQRPRDQDNTRPHDQYGIVFSVSGDDVARKQGDSFSQPDPTVATMGSVDTVTIGEALEATALSLGDKPVDRRDAAAIQAAETRATGESKGRPGGLAVAAQAAATTNEQTVSEEDKVNIADILTDAAERLPGDKVVTSEDAEAVVGAELRSSSEMKTTPGGVADSMSAGARLNQQL

SEQ ID NO: 544 - protein, 204 aa, Arabidopsis thaliana
MATQAAGIFSPAITTTTSAVKKLHLFSSSHRPKSLSFTKTAIRAEKTESSSAAPAVKEAPVGFTPPQLDPNTPSPIFAGSTGGLLRKAQVEEFYVITWNSPKEQIFEMPTGGAAIMREGPNLLKLARKEQCLALGTRLRSKYKITYQFYRVFPNGEVQYLHPKDGVYPEKANPGREGVGLNMRSIGKNVSPIEVKFTGKQSYDL

SEQ ID NO: 545 - protein, 775 aa, Arabidopsis thaliana
MEPKPFFLCIIFLLFCSSSSEILQKQTYIVQLHPNSETAKTFASKFDWHLSFLQEAVLGVEEEEEEPSSRLLYSYGSAIEGFAAQLTESEAEILRYSPEVVAVRPDHVLQVQTTYSYKFLGLDGFGNSGVWSKSRFGQGTIIGVLDTGVWPESPSFDDTGMPSIPRKWKGICQEGESFSSSSCNRKLIGARFFIRGHRVANSPEESPNMPREYISARDSTGHGTHTASTVGGSSVSMANVLGNGAGVARGMAPGAHIAVYKVCWFNGCYSSDILAAIDVAIQDKVDVLSLSLGGFPIPLYDDTIAIGTFRAMERGISVICAAGNNGPIESSVANTAPWVSTIGAGTLDRRFPAVVRLANGKLLYGESLYPGKGIKNAGREVEVIYVTGGDKGSEFCLRGSLPREEIRGKMVICDRGVNGRSEKGEAVKEAGGVAMILANTEINQEEDSIDVHLLPATLIGYTESVLLKAYVNATVKPKARIIFGGTVIGRSRAPEVAQFSARGPSLANPSILKPDMIAPGVNIIAAWPQNLGPTGLPYDSRRVNFTVMSGTSMSCPHVSGITALIRSAYPNWSPAAIKSALMTTADLYDRQGKAIKDGNKPAGVFAIGAGHVNPQKAINPGLVYNIQPVDYITYLCTLGFTRSDILAITHKNVSCNGILRKNPGFSLNYPSIAVIFKRGKTTEMITRRVTNVGSPNSIYSVNVKAPEGIKVIVNPKRLVFKHVDQTLSYRVWFVLKKKNRGGKVASFAQGQLTWVNSHNLMQRVRSPISVTLKTN

SEQ ID NO: 546 - protein, 223 aa, Arabidopsis thaliana
MASSLVSSFQPRSAFLGDRNVFKVSSTPFAQVGYSSKTIECKESRIGKQPIAVPSNVTIALEGQDLKVKGPLGELALTYPREVELTKEESGFLRVKKTVETRRANQMHGLFRTLTDNMVVGVSKGFEKKLILVGVGYRATVDGKELVLNLGFSHPVKMQIPDSLKVKVEENTRITVSGYDKSEIGQFAATVRKWRPPEPYKGKGVKYSDEIVRRKEGKAGKKK

SEQ ID NO: 547 - protein, 473 aa, Arabidopsis thaliana
MCLSLASTAQRNTQFRSRVLVLAELVKSMGHQNAAVSENQNHDDGAASSPGFKLVGFSKFVRKNPKSDKFKVKRFHHIEFWCGDATNVARRFSWGLGMRFSAKSDLSTGNMVHASYLLTSGDLRFLFTAPYSPSLSAGEIKPTTTASIPSFDHGSCRSFFSSHGLGVRAVAIEVEDAESAFSISVANGAIPSSPPIVLNEAVTIAEVKLYGDVVLRYVSYKAEDTEKSEFLPGFERVEDASSFPLDYGIRRLDHAVGNVPELGPALTYVAGFTGFHQFAEFTADDVGTAESGLNSAVLASNDEMVLLPINEPVHGTKRKSQIQTYLEHNEGAGLQHLALMSEDIFRTLREMRKRSSIGGFDFMPSPPPTYYQNLKKRVGDVLSDDQIKECEELGILVDRDDQGTLLQIFTKPLGDRPTIFIEIIQRVGCMMKDEEGKAYQSGGCGGFGKGNFSELFKSIEEYEKTLEAKQLVG

SEQ ID NO: 548 - protein, 595 aa, Arabidopsis thaliana
MDLCFQNPVKCGDRLFSALNTSTYYKLGTSNLGFNGPVLENRKKKKKLPRMVTVKSVSSSVVASTVQGTKRDGGESLYDAIVIGSGIGGLVAATQLAVKEARVLVLEKYLIPGGSSGFYERDGYTFDVGSSVMFGFSDKGNLNLITQALKAVGRKMEVIPDPTTVHFHLPNNLSVRIHREYDDFIAELTSKFPHEKEGILGFYGDCWKIFNSLNSLELKSLEEPIYLFGQFFQKPLECLTLAYYLPQNAGAIARKYIKDPQLLSFIDAECFIVSTVNALQTPMINASMVLCDRHYGGINYPVGGVGGIAKSLAEGLVDQGSEIQYKANVKSIILDHGKAVGVRLADGREFFAKTIISNATRWDTFGKLLKGEKLPKEEENFQKVYVKAPSFLSIHMGVKAEVLPPDTDCHHFVLEDDWKNLEEPYGSIFLSIPTILDSSLAPDGRHILHIFTTSSIEDWEGLPPKEYEAKKEDVAARIIQRLEKKLFPGLSSSITFKEVGTPRTHRRFLARDKGTYGPMPRGTPKGLLGMPFNTTAIDGLYCVGDSCFPGQGVIAVAFSGVMCAHRVAADIGLEKKSRVLDVGLLGLLGWLRTLA

SEQ ID NO: 549 - protein, 263 aa, Arabidopsis thaliana
MLELRLVQGSLLKKVLESIKDLVNDANFDCSSTGFSLQAMDSSHVALVSLLLRSEGFEHYRCDRNLSMGMNLGNMSKMLKCAGNDDIITIKADDGGDTVTFMFESPTQDKIADFEMKLMDIDSEHLGIPDAEYHSIVRMPSNEFSRICKDLSSIGDTVVISVTKEGVKFSTAGDIGTANIVLRQNTTVDKPEDAIVIEMKEPVSLSFALRYMNSFTKATPLSDTVTISLSSELPVVVEYKVAEMGYIRYYLAPKIEEEEDTNP

SEQ ID NO: 550 - protein, 530 aa, Arabidopsis thaliana
MGDSTGEPGSSMHGVTGREQSFAFSVQSPIVHTDKTAKFDLPVDTEHKATVFKLFSFAKPHMRTFHLSWISFSTCFVSTFAAAPLVPIIRENLNLTKQDIGNAGVASVSGSIFSRLVMGAVCDLLGPRYGCAFLVMLSAPTVFSMSFVSDAAGFITVRFMIGFCLATFVSCQYWMSTMFNSQIIGLVNGTAAGWGNMGGGITQLLMPIVYEIIRRCGSTAFTAWRIAFFVPGWLHIIMGILVLNLGQDLPDGNRATLEKAGEVAKDKFGKILWYAVTNYRTWIFVLLYGYSMGVELSTDNVIAEYFFDRFHLKLHTAGLIAACFGMANFFARPAGGYASDFAAKYFGMRGRLWTLWIIQTAGGLFCVWLGRANTLVTAVVAMVLFSMGAQAACGATFAIVPFVSRRALGIISGLTGAGGNFGSGLTQLLFFSTSHFTTEQGLTWMGVMIVACTLPVTLVHFPQWGSMFLPPSTDPVKGTEAHYYGSEWNEQEKQKNMHQGSLRFAENAKSEGGRRVRSAATPPENTPNNV

SEQ ID NO: 551 - protein, 760 aa, Arabidopsis thaliana
MAMTPVASSSPVSTCRLFRCNLLPDLLPKPLFLSLPKRNRIASCRFTVRASANATVESPNGVPASTSDTDTETDTTSYGRQFFPLAAVVGQEGIKTALLLGAVDREIGGIAISGRRGTAKTVMARGLHEILPPIEVVVGSISNADPACPDEWEDDLDERIEYNADNTIKTEIVKSPFIQIPLGVTEDRLIGSVDVEESVKRGTTVFQPGLLAEAHRGVLYVDEINLLDEGISNLLLNVLTDGVNIVEREGISFRHPCKPLLIATYNPEEGAVREHLLDRVAINLSADLPMSFEDRVAAVGIATQFQERCNEVFRMVNEETETAKTQIILAREYLKDVKISREQLKYLVLEAVRGGVQGHRAELYAARVAKCLAAIEGREKVTIDDLRKAVELVILPRSSLDETPPEQQNQPPPPPPPPQNSESGEEENEEEQEEEEEDESNEENENEQQQDQIPEEFIFDAEGGLVDEKLLFFAQQAQKRRGKAGRAKNVIFSEDRGRYIKPMLPKGPVKRLAVDATLRAAAPYQKLRREKDISGTRKVFVEKTDMRAKRMARKAGALVIFVVDASGSMALNRMQNAKGAALKLLAESYTSRDQVSIIPFRGDAAEVLLPPSRSIAMARNRLERLPCGGGSPLAHGLTTAVRVGLNAEKSGDVGRIMIVAITDGRANITLKRSTDPESIAPDAPRPTSKELKDEILEVAGKIYKAGMSLLVIDTENKFVSTGFAKEIARVAQGKYYYLPNASDAVISATTRDALSDLKNS

SEQ ID NO: 552 - protein, 1296 aa, Arabidopsis thaliana
MPPRKKPKSSALKSNKQSSANHSSQPSTFGIQQLFLRHIQNSQSTSNSHTSTADPVDQQNVNGLASDTAVLTPQNPLGTSNEKPDESKDMDQQLTEASPKISKNLKRFSPGMLIKQSQDDCGGEITWKISPVNERLRAAAKNIPKMMDLTENSLGKQCPTSGITSKVEQWLSSPSKKASKRPAFATNRVMERVNPSPDAEFEIVNTSSSGNSPFQTPPSLSCPHNKLPCTVTCSGACGSMGAGQHKKALLELLDQVEDVIAVDDKTTDDVGIVMPQARVKDDIISSVVDCAVDEGPVSLPKMQNSINPDSYFLVLEVSEKRGSGSSSKGQCPYKVLRLLDEHTGVECALYLWDEWFYSTVSPGDSINVIGEFDGDGKCDVDRQNNFLIVHPDTLVAGTRVAASFGCPRRTVLDERLRSNEHATVALLGTLQHQVFQAGLSQESPSVDGLQEYASTVIEKSIESLYACGVHEGDVRSTLFKAIPKMLNWIEHFRYSKDSEVSKVDFGSTIGKKAVKVSEVIDIEEMSWAPKYGLKGMIDASVRVIVESDMNTVNEKIMPLEFKSGKAPSGQSSIEHSAQVILYTLLMSERYLKHIDNGLLYYLQSDQTQGISVQRSDLVGLIIRRNELANDILVASTTQQLPPMLRADGGNTESSGLGDVFDTHVSHLSTLHFNFLRHWDRLIDLEGREMQLLRKDIAHPHGSKGSHSASYLSSMVLDVTNGFQHHNSHKETRFIYRFVRQKSSESRERVTSEDMIRTGNLATDDLDCKLRTGDRVILRTEVSHLTVANGIIADISRTHISVSLSKRLRLPWSEPSSEVSNLSHELWRIYKDEFMTSFSVMRFNLMQLFVQNGHNIRKMIVDLEPPRFDNGSILSQDPAISYIWSEKSLNNDQRQAILKILTAKDYALILGMPGTGKTSTMVHAVKALLIRGSSILLASYTNSAVDNLLIKLKAQGIEFLRIGRDEAVHEEVRESCFSAMNMCSVEDIKKKLDQVKVVASTCLGINSPLLVNRRFDVCIIDEAGQIALPVSIGPLLFASTFVLVGDHYQLPPLVQSTEARENGMGISLFRRLSEAHPQAISVLQNQYRMCRGIMELSNALIYGDRLCCGSAEVADATLVLSTSSSTSPWLKKVLEPTRTVVFVNTDMLRAFEARDQNAINNPVEASIIAEIVEELVNNGVDSKDIGIITPYNSQASLIQHAIPTTPVEIHTIDKYQGRDKDCILVSFVRSREKPRSSASSLLGDWHRINVALTRAKKKLIMVGSQRTLSRVPLLMLLLNKVKEQSGILNLLPGDLKP

SEQ ID NO: 553 - protein, 666 aa, Arabidopsis thaliana
MQDFFGSVRRSLVFRPSSDDDNQENQPPFPGVLADKITSCIRKSKIFIKPSFSPPPPANTVDMAPPISWRKGQLIGRGAFGTVYMGMNLDSGELLAVKQVLIAANFASKEKTQAHIQELEEEVKLLKNLSHPNIVRYLGTVREDDTLNILLEFVPGGSISSLLEKFGPFPESVVRTYTRQLLLGLEYLHNHAIMHRDIKGANILVDNKGCIKLADFGASKQVAELATMTGAKSMKGTPYWMAPEVILQTGHSFSADIWSVGCTVIEMVTGKAPWSQQYKEVAAIFFIGTTKSHPPIPDTLSSDAKDFLLKCLQEVPNLRPTASELLKHPFVMGKHKESASTDLGSVLNNLSTPLPLQINNTKSTPDSTCDDVGDMCNFGSLNYSLVDPVKSIQNKNLWQQNDNGGDEDDMCLIDDENFLTFDGEMSSTLEKDCHLKKSCDDISDMSIALKSKFDESPGNGEKESTMSMECDQPSYSEDDDELTESKIKAFLDEKAADLKKLQTPLYEEFYNSLITFSPSCMESNLSNSKREDTARGFLKLPPKSRSPSRGPLGGSPSRATDATSCSKSPGSGGSRELNINNGGDEASQDGVSARVTDWRGLVVDTKQELSQCVALSEIEKKWKEELDQELERKRQEIMRQAGLGSSPRDRGMSRQREKSRFASPGK

SEQ ID NO: 554 - protein, 259 aa, Arabidopsis thaliana
MARDGGVSCLRRSEMMSVGGIGGIESAPLDLDEVHVLAVDDSLVDRIVIERLLRITSCKVTAVDSGWRALEFLGLDNEKASAEFDRLKVDLIITDYCMPGMTGYELLKKIKESSNFREVPVVIMSSENVLTRIDRCLEEGAQDFLLKPVKLADVKRLRSHLTKDVKLSNGNKRKLPEDSSSVNSSLPPPSPPLTISPESSPPLTVSTESSDSSPPLSPVEIFSTSPLSSPIDDEDDDVLTSSSEESPIRRQKMRSPGLD

SEQ ID NO: 555 - protein, 605 aa, Arabidopsis thaliana
MASSSTSSLNLHSLPKASSGLGQWKSGFRYELLGSSVSRNRLFVSPVVIHHRSPRLPAIKAAYNSDGGSKRSRVYKESQAASGFPNAKVQQIASSVLPLGSFAVVTFVLWKVVGKFMSPKSPKTSAGENNSSTQGVKWSIGAGTNLLQGFAAKVDREAKQRLNEFAKELRSFRSVDMSGCNFGDEGLFFLAESLGYNQTVEEVSFSANGITAAGVKAFDGVLQSNIMLKILNLSGNPIGDEGAKTLCATLMENSSIEILQLNSTDIGDEGAKEIAELLKRNSTLRIIELNNNMIDYSGFTSLAGALLENNTIRNLHLNGNYGGALGANALAKGLEGNKSLRELHLHGNSIGDEGTRALMAGLSSHKGKVALLDLGNNSISAKGAFYVAEYIKRSKSLVWLNLYMNDIGDEGAEKIADSLKQNRSIATIDLGGNNIHAEGVNAIAQALKDNAIITTLEVGYNPIGPDGAKALSEILKFHGNVKTLKLGWCQIAAKGAEHVADMLRYNNTISVLDLRANGLRDEGASCLARSLKVVNEALTSVDLGFNEIRDDGAFAIAQALKANEDVTVTSINLGNNFITKFGQSALTDARDHVLEMTEKEVEIFF

SEQ ID NO: 556 - protein, 512 aa, Arabidopsis thaliana
MGLHKLRLAAAVPVTFSSRLFLKPFTNTLTLGLFSRHLQPRNKPLLVRAFSASAAVQDIPATQTSDSSARPLWKAAIDFKWIRDNKEAVEINIRNRNSNANLEAVLQLYENMVNLQKEVERLREERNNVAKKMKGKLEPSERERLVEEGKNLKESLVTLEEDLVKLKDELQHVAQSIPNMTHPDVPVGGEDSSAIRQEVGSPREFSFPIKDHLQLGKDLDLIDFDSAAEVSGSKFFYLKNEAVLLEMALLNWTLSQVMKKGYTPLTTPEIVRSSIVEKCGFQPRGDNTQVYSIDGTDQCLIGTAEIPVGGIHMDSILLESALPLKYIAFSHCFRTEAGAAGAATKGLYRVHQFSKAEMFVICQPEDSESFHQELIQIEEDLFTSLGLHFKTLDMATADLGAPAYRKFDIEAWMPGLGRFGEISSASNCTDYQSRRLGIRYRPSEPPQTGPKKGKANLPATKFVHTLNATACAVPRMMVCLLENYQQEDGSVVIPEPLRPFMGGIELIKPKHK

SEQ ID NO: 557 - protein, 551 aa, Arabidopsis thaliana
MAASTSTRFLVLLKDFSAFRKISWTCAATNFHRQSRFLCHVAKEDGSLTLASLDLGNKPRKFGKGKAMKLEGSFVTEMGQGKVRAVKNDKMKVVKEKKPAEIVSPLFSAKSFEELGLPDSLLDSLEREGFSVPTDVQSAAVPAIIKGHDAVIQSYTGSGKTLAYLLPILSEIGPLAEKSRSSHSENDKRTEIQAMIVAPSRELGMQIVREVEKLLGPVHRRMVQQLVGGANRMRQEEALKKNKPAIVVGTPGRIAEISKGGKLHTHGCRFLVLDEVDELLSFNFREDIHRILEHVGKRSGAGPKGEVDERANRQTILVSATVPFSVIRAAKSWSHEPVLVQANKVTPLDTVQPSAPVMSLTPTTSEADGQIQTTIQSLPPALKHYYCISKHQHKVDTLRRCVHALDAQSVIAFMNHSRQLKDVVYKLEARGMNSAEMHGDLGKLGRSTVLKKFKNGEIKVLVTNELSARGLDVAECDLVVNLELPTDAVHYAHRAGRTGRLGRKGTVVTVCEESQVFIVKKMEKQLGLPFLYCEFVDGELVVTEEDKAIIR

SEQ ID NO: 558 - protein, 177 aa, Arabidopsis thaliana
MAAVQQQQAMQKNTLYVGGLADEVNESILHAAFIPFGDIKDVKTPLDQANQKHRSFGFVTFLEREDASAAMDNMDGAELYGRVLTVNYALPEKIKGGEQGWAAHPLWADADTWFERQQQEKEILKMQAENKAAMETAEELHRKKLAEDRQGEMEEDTDTKNDPMARAEADALSHGDA

SEQ ID NO: 559 - protein, 302 aa, Arabidopsis thaliana
MALVVICGQPCSGKSIAAVTLAETLKESETKQSVRIIDEASFHLDRNQNYANMPAEKNLRGKLRSDVDRSVSTGEIVIVDSLNSIKGYRYELWCIARAAGIRYCVVYCDVDEAHCRQWNKERSDRGEDGYDDGIFEDLVRRFEKPERRNRWDSPLFELYPSREVIDKSSPVILEAVTYLTKTVDSKTQDVRILQPSIATQAARFSEANSLYELDRATQEIINAIVEQQSLGAAISRVTLGNELPPIEICRPIGLPELRRLRRTFVKLMGQSSLSGPPLPTDADSAKRRFVDYLNREFGGNNA

SEQ ID NO: 560 - protein, 190 aa, Arabidopsis thaliana
MSSFTTTNTPPPYLLRKIYHRRVNQPFSVVCCTGEPQQDIFTRRRTLTSLITFTVIGGATSSALAQEKWGTRSFIKEKYFMPGLSPEDAAARIKQTAEGLRDMREMLDHMSWRYVIFYIRLKQAYLSQDLTNAMNILPESRRNDYVQAANELVENMSELDFYVRTPKVYESYLYYEKTLKSIDNVVEFLA

SEQ ID NO: 561 - protein, 450 aa, Arabidopsis thaliana
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKYKSVAVLTSPKLLDTLF

SEQ ID NO: 562 - protein, 258 aa, Arabidopsis thaliana
MAMAVSGAVLSGLGSSFLTGGKRGATALASGVGTGAQRVGRKTLIVAAAAAQPKKSWIPAVKGGGNFLDPEWLDGSLPGDFGFDPLGLGKDPAFLKWYREAELIHGRWAMAAVLGIFVGQAWSGVAWFEAGAQPDAIAPFSFGSLLGTQLLLMGWVESKRWVDFFNPDSQSVEWATPWSKTAENFANYTGDQGYPGGRFFDPLGLAGKNRDGVYEPDFEKLERLKLAEIKHSRLAMVAMLIFYFEAGQGKTPLGALGL

SEQ ID NO: 563 - protein, 441 aa, Arabidopsis thaliana
MYGGDEVSAIVVDLGSHTCKAGYAGEDAPKAVFPSVIGAVDGVEAMDVDVDSTKTNSNSEDSKTESEKEKSKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYAEMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 564 - protein, 206 aa, Arabidopsis thaliana; identical to SEQ ID NO: 155

SEQ ID NO: 565 - protein, 429 aa, Arabidopsis thaliana
MVRSDENSLGLIGSMSLQGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 566 - protein, 315 aa, Arabidopsis thaliana
MDNNGVKPAVSAMEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 567 - protein, 238 aa, Arabidopsis thaliana
MERGAPFSHYQLPKSISELNLDQHSNNPTPMTSSVVVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 568 - protein, 1173 aa, Arabidopsis thaliana
MASSSSSERWIDGLQFSSLLWPPPRDPQQHKDQVVAYVEYFGQFTSEQFPDDIAELVRHQYPSTEKRLLDDVLAMFVLHHPEHGHAVILPIISCLIDGSLVYSKEAHPFASFISLVCPSSENDYSEQWALACGEILRILTHYNRPIYKTEQQNGDTERNCLSKATTSGSPTSEPKAGSPTQHERKPLRPLSPWISDILLAAPLGIRSDYFRWCSGVMGKYAAGELKPPTIASRGSGKHPQLMPSTPRWAVANGAGVILSVCDDEVARYETATLTAVAVPALLLPPPTTSLDEHLVAGLPALEPYARLFHRYYAIATPSATQRLLLGLLEAPPSWAPDALDAAVQLVELLRAAEDYASGVRLPRNWMHLHFLRAIGIAMSMRAGVAADAAAALLFRILSQPALLFPPLSQVEGVEIQHAPIGGYSSNYRKQIEVPAAEATIEATAQGIASMLCAHGPEVEWRICTIWEAAYGLIPLNSSAVDLPEIIVATPLQPPILSWNLYIPLLKVLEYLPRGSPSEACLMKIFVATVETILSRTFPPESSRELTRKARSSFTTRSATKNLAMSELRAMVHALFLESCAGVELASRLLFVVLTVCVSHEAQSSGSKRPRSEYASTTENIEANQPVSNNQTANRKSRNVKGQGPVAAFDSYVLAAVCALACEVQLYPMISGGGNFSNSAVAGTITKPVKINGSSKEYGAGIDSAISHTRRILAILEALFSLKPSSVGTPWSYSSSEIVAAAMVAAHISELFRRSKALTHALSGLMRCKWDKEIHKRASSLYNLIDVHSKVVASIVDKAEPLEAYLKNTPVQKDSVTCLNWKQENTCASTTCFDTAVTSASRTEMNPRGNHKYARHSDEGSGRPSEKGIKDFLLDASDLANFLTADRLAGFYCGTQKLLRSVLAEKPELSFSVVSLLWHKLIAAPEIQPTAESTSAQQGWRQVVDALCNVVSATPAKAAAAVVLQAERELQPWIAKDDEEGQKMWKINQRIVKVLVELMRNHDRPESLVILASASDLLLRATDGMLVDGEACTLPQLELLEATARAIQPVLAWGPSGLAVVDGLSNLLKCRLPATIRCLSHPSAHVRALSTSVLRDIMNQSSIPIKVTPKLPTTEKNGMNSPSYRFFNAASIDWKADIQNCLNWEAHSLLSTTMPTQFLDTAARELGCTISLSQ

SEQ ID NO: 569 - protein, 351 aa, Arabidopsis thaliana
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVSKYNLTMLILFPLAVNGSMKLT

SEQ ID NO: 570 - protein, 615 aa, Arabidopsis thaliana
MITWHDLYTVLTAVIPLYVAMILAYGSVRWWKIFSPDQCSGINRFVAIFAVPLLSFHFISSNNPYAMNLRFIAADTLQKLIMLTLLIIWANFTRSGSLEWSITIFSLSTLPNTLVMGIPLLIAMYGEYSGSLMVQIVVLQCIIWYTLLLFLFEYRGAKILIMEQFPETGASIVSFKVESDVVSLDGHDFLETDAQIGDDGKLHVTVRKSNASRRSFYGGGGTNMTPRPSNLTGAEIYSLNTTPRGSNFNHSDFYSMMGFPGGRLSNFGPADMYSVQSSRGPTPRPSNFEESCAMASSPRFGYYPGGAPGSYPAPNPEFSTGNKTGSKAPKENHHHVGKSNSNDAKELHMFVWGSNGSPVSDRAGLQVDNGANEQVGKSDQGGAKEIRMLISDHTQNAGPMNGDYGGEEESERVKEVPNGLHKLRCNSTAELNPKEAIETGETVPVKHMPPASVMTRLILIMVWRKLIRNPNTYSSLIGLIWALVAFRWDVAMPKIIQQSISILSDAGLGMAMFSLGLFMALQPKLIACGNSTATFAMAVRFFTGPAVMAVAAMAIGLRGDLLRVAIVQAALPQGIVPFVFAKEYNVHPAILSTGVIFGMLIALPITLVYYILLGL

SEQ ID NO: 571 - protein, 251 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 572 - protein, 709 aa, Arabidopsis thaliana
MAILGLIKRVTRITVNNSRVRVYPVRYFQRKDLSSTNLFNGEDAAKLPVLIVGAGPVGLVLSILLTKLGVKCAVVDKATSFSKHPQAHFINNRSMEIFRELDGLAEEIERSQPPVDLWRKFIYCTSLSGSTLGTVDHMQPQDFEKVVSPASVAHFSQYKLTNLLLKRLEDLGFHVRGSKESDGLEADSVVARQILMGHECVGIDANKDSITATVSFLKGGKHMKRNIQCSLLVGADGAGSAVRKLTVIEMRGERDLQKLVSVHFMSRELGEYLISNRPGMLFFIFNTDGIGVLVAHDLLQGEFVLQIPYYPPQQSLSDFSPEMCKMLIFNLVGHELSDLDVADIKPWVMHAEVAEKFMCCENRVILAGDAAHRFPPAGGFGMNTGIQDAHNLAWKIAALVQGSANSSILKTYETERRPIALSNTSLSVQNFRAAMSVPSALGLDPTVANSVHRFINKTVGSILPTGLQKAILDNVFALGRAQLSESLLNESNPLGNQRLSRLKSIFEGGKSLQLQFPAEDLGFRYLEGAIVPDNESEAGDPEVPSGRRRDYVPCAEPGSRLPHMYVKILSDSTREVIVSTLDLVSTEKVEFLLIISPLQESYELAHATFKVAKEFMASVKVCVVWPSSDDGLERKSNSALAPWENYVDVMEVKKQNGEGTSWWSICKMSERGSILVRPDQHIAWRAKSGITLDPTLHMRDVFTIILGKQ

SEQ ID NO: 573 - protein, 449 aa, Arabidopsis thaliana
MAGRSWLIDSNRIATKIMSASASSDPRQVVWKSNPSRHCPKCQHVIDNSDVVDDWPGLPRGVKFDPSDPEIIWHLLAKSGLSGLSSHPFIDEFIPTVNQDDGICYTHPKNLPGVKSDGTVSHFFHKAIKAYSTGTRKRRKIHDDDFGDVRWHKTGRTKPVVLDGVQRGCKKIMVLYGGKAVKTNWVMHQYHLGIEEDEKEGDYVVSKIFYQQPQQLVVKRGDKAEQEVSEDIFAAVTPTADPVTPKLATPEPRNAVRICSDSHIASDYVTPSDYVSAHEVSLAETSEVMCMEDEVQSIQPNHERPSSGPELEHGLENGAKEMLDDKEEQEKDRDNENQGEEDPTWFDSGSQFILNSQQLVEALSLCDDLLGSQDREENTNSGSLKDKQPCIADYAHLGPEDFKRDLEECQKIVLDPSNIELDTPPEFRLSQLEFGSQDSFLAWGTGKTD

SEQ ID NO: 574 - protein, 255 aa, Arabidopsis thaliana; identical to SEQ ID NO: 151

SEQ ID NO: 575 - protein, 244 aa, Arabidopsis thaliana
MSTGISSDLHLHPRALNFSKTSKSGLSNRKVSFSSVGYAQNRKLSCSVSSTENVAPKDDDRGKDRPLVKMCGITSARDAAMAVEAGADFIGMIIWPHSKRSISLSVAKDISQVAREGGAKPVGVFVEDDENTILRAADSSDLELVQLHGNSSRAAFSRLVRERKVIYVLNANEDGKLLNVVPEEDGHLADWILVDSATGGRYLDQLLSFFALSHCNVFLRGTSYTITLVHETVCLSQVTEISRV

SEQ ID NO: 576 - protein, 1006 aa, Arabidopsis thaliana
MAVTISTNAFVNASLLDESRNSFWRPLFHQPYYNCRRVVRLNSRKLNSKVMFCLNLNTKEVGLQKPGDKGFEFKPSFDQYLQIMESVKTARKKKKFDRLKVEEDDGGGGNGDSVYEVKDMKIKSGELKDETFRKRYSRQEIVSDKRNERVFKRNGEIENHRVATDLKWSKSGESSVALKLSKSGESSVTVPEDESFRKRYSKQEYHRSSDTSRGIERGSRGDELDLVVEERRVQRIAKDARWSKSRESSVAVKWSNSGESSVTMPKDESFRRRYSKQEHHRSSDTSRGIARGSKGDELELVVEERRVQRIAKDVRWSKSDESLVPVSEDESFRRGNPKQEMVRYQRVSDTSRGIERGSKGDGLDLLAEERRIERLANERHEIRSSKLSGTRRIGAKRNDDDDDSLFAMETPAFRFSDESSDIVDKPATSRVEMEDRIEKLAKVLNGADINMPEWQFSKAIRSAKIRYTDYTVMRLIHFLGKLGNWRRVLQVIEWLQRQDRYKSNKIRIIYTTALNVLGKSRRPVEALNVFHAMLLQISSYPDMVAYRSIAVTLGQAGHIKELFYVIDTMRSPPKKKFKPTTLEKWDPRLEPDVVVYNAVLNACVQRKQWEGAFWVLQQLKQRGQKPSPVTYGLIMEVMLACEKYNLVHEFFRKMQKSSIPNALAYRVLVNTLWKEGKSDEAVHTVEDMESRGIVGSAALYYDLARCLCSAGRCNEGLNMVNFVNPVVLKLIENLIYKADLVHTIQFQLKKICRVANKPLVVTYTGLIQACVDSGNIKNAAYIFDQMKKVCSPNLVTCNIMLKAYLQGGLFEEARELFQKMSEDGNHIKNSSDFESRVLPDTYTFNTMLDTCAEQEKWDDFGYAYREMLRHGYHFNAKRHLRMVLEASRAGKEEVMEATWEHMRRSNRIPPSPLIKERFFRKLEKGDHISAISSLADLNGKIEETELRAFSTSAWSRVLSRFEQDSVLRLMDDVNRRLGSRSESSDSVLGNLLSSCKDYLKTRTHNL

SEQ ID NO: 577 - protein, 459 aa, Arabidopsis thaliana
MTLTFSSSAATVAVAAATVTSSARVPVYPLASSTLRGLVSFRLTAKKLFLPPLRSRGGVSVRAMSELVQDKESSVAASIAFNEAAGETPSELSHSRTFLDARSEQDLLSGIKKEAEAGRLPANVAAGMEELYWNYKNAVLSSGASRADETVVSNMSVAFDRMLLGVEDPYTFNPYHKAVREPFDYYMFVHTYIRPLIDFKNSYVGNASIFSELEDKIRQGHNIVLISNHQSEADPAVISLLLEAQSPFIGENIKCVAGDRVITDPLCKPFSMGRNLICVYSKKHMNDDPELVDMKRKANTRSLKEMATMLRSGGQLIWIAPSGGRDRPNPSTGEWFPAPFDASSVDNMRRLVEHSGAPGHIYPMSLLCYDIMPPPPQVEKEIGEKRLVGFHGTGLSIAPEINFSDVTADCESPNEAKEAYSQALYKSVNEQYEILNSAIKHRRGVEASTSRVSLSQPWN

SEQ ID NO: 578 - protein, 652 aa, Arabidopsis thaliana
MNQIKNKTLPEMTTEQALLSMEALPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPRGERTNWIMHEYRATDKELDGTGPGQNPYVLCRLFHKPSDSCDPAHCEEIEKVNFTPTTTTRCSPDDTSSEMVQETATSGVHALDRSDDTERCLSDKGNNDVKPDVSVINNTSVNHAETSRAKDRNLGKTLVEENPLLRDVPTLHGPILSEKSYYPGQSSIGFATSHMDSMYSSDFGNCDYGLHFQDGASEQDASLTDVLDEVFHNHNESSNDRKDFVLPNMMHWPGNTRLLSTEYPFLKDSVAFVDGSAEVSGSQQFVPDILASRWVSEQNVDSKEAVEILSSTGSSRTLTPLHNNVFGQYASSSYAAIDPFNYNVNQPEQSSFEQSHVDRNISPSNIFEFKARSRENQRDLDSVVDQGTAPRRIRLQIEQPLTPVTNKKERDADNYEEEDEVQSAMSKVVEEEPANLSAQGTAQRRIRLQTRLRKPLITLNNTKRNSNGREGEASHRKCEMQEKEDISSSSSWQKQKKSLVQFSSVVIIVAVIVVLVEIWKESRDAKCSFLFHQLDSFKGMFT

SEQ ID NO: 579 - protein, 305 aa, Arabidopsis thaliana
MSSSNGGVPPGFRFHPTDEELLHYYLKKKISYEKFEMEVIKEVDLNKIEPWDLQDRCKIGSTPQNEWYFFSHKDRKYPTGSRTNRATHSGFWKATGRDKCIRNSYKKIGMRKTLVFYKGRAPHGQKTDWIMHEYRIEDTEDDPCEDGWVVCRVFKKKNLFKVGNDVGSNISNNRLEARSFIRRESPYQGISMFELNKPEEISVHQYPQPPMFQPHHKPLSIGYDYSLALLPRESEYQQACQPSGVEVGTCKAVSEWGIVNCNMVSHEDSSRAMRFEDDGNNTSSTVQPPSNLLSLRGENGFLGLF

SEQ ID NO: 580 - protein, 447 aa, Arabidopsis thaliana
MATHAALAVSRIPVTQRLQSKSAIHSFPAQCSSKRLEVAEFSGLRMSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 581 - protein, 482 aa, Arabidopsis thaliana
MVGSLESDQTLSMATLIEKLDILSDDFDPTAVVTEPLPPPVTNGIGADKGGGGGEREMVLGRNIHTTSLAVTEPEVNDEFTGDKEAYMASVLARYRKTLVERTKNHLGYPYNLDFDYGALGQLQHFSINNLGDPFIESNYGVHSRPFEVGVLDWFARLWEIERDDYWGYITNCGTEGNLHGILVGREMFPDGILYASRESHYSVFKAARMYRMECEKVDTLMSGEIDCDDLRKKLLANKDKPAILNVNIGTTVKGAVDDLDLVIKTLEECGFSHDRFYIHCDGALFGLMMPFVKRAPKVTFNKPIGSVSVSGHKFVGCPMPCGVQITRMEHIKVLSSNVEYLASRDATIMGSRNGHAPLFLWYTLNRKGYKGFQKEVQKCLRNAHYLKDRLREAGISAMLNELSSTVVFERPKDEEFVRRWQLACQGDIAHVVVMPSVTIEKLDNFLKDLVKHRLIWYEDGSQPPCLASEVGTNNCICPAHK

SEQ ID NO: 582 - protein, 460 aa, Arabidopsis thaliana
MSNILQNRRSSFSSSTKSSLAKRQAPSSSENSVKLMPAMTKKRAPLSNITNQKIASRLQNSDSVHCSNKSAKLKIAPSVCVNASFSSNLQQSIVPHKVASSPSKSDDGSVSMDETRSSSDSYKSPQVEYIENDDVSAVVSIERKALSNLFITPNSETIDNYCSRDVLSDMKKMDKNQIVNIDSNNGDPQLCATFACDIYKHLRASEAKKRPDVDYMERVQKDVNSSMRGILVDWLIEVSEEYRLVPETLYLTVNYIDRYLSGNVISRQKLQLLGVACMMIAAKYEEICAPQVEEFCYITDNTYLKDEVLDMESDVLNYLKFEMTAPTTKCFLRRFVRAAHGVHEAPLMQLECMANYIAELSLLEYTMLSHSPSLVAASAIFLAKYILDPTRRPWNSTLQHYTQYKAMELRGCVKDLQRLCSTAHGSTLPAVREKYSQHKYKFVAKKFCPSVIPQEFFNNS

SEQ ID NO: 583 - protein, 433 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPRFLLTLITLFSAKMKLGLSFLFLVLQFGEVFNTYLGSPRILGSISNRYGI

SEQ ID NO: 584 - protein, 256 aa, Arabidopsis thaliana
MAVVLRGGITGGFLHHRRDASSVITRRISSVKAAGGGINPTVAVERATWLPGLNPPPYLDGNLAGDYGFDPLGLGEDPESLKWYVQAELVHSRFAMLGVAGILFTDLLRTTGIRNLPVWYEAGAVKFDFASTKTLIVVQFLLMGFAETKRYMDFVSPGSQAKEGSFFFGLEAALEGLEPGYPGGPLLNPLGLAKDVQNAHDWKLKEIKNGRLAMMAMLGFFVQASVTHTGPIDNLVEHLSNPWHKTIIQTLFTSTS

SEQ ID NO: 585 - protein, 484 aa, Arabidopsis thaliana
MGKDKTLPLLDPREPPELTGTKSASKVWAKEFGEESKRLWELAGPAIFTAISQYSLGALTQTFSGRLGELELAAVSVENSVISGLAFGVMLGMGSALETLCGQAYGAGQIRMMGIYMQRSWVILFTTALFLLPVYIWAPPILSFFGEAPHISKAAGKFALWMIPQLFAYAANFPIQKFLQSQRKVLVMAWISGVVLVIHAVFSWLFILYFKWGLVGAAITLNTSWWLIVIGQLLYILITKSDGAWTGFSMLAFRDLYGFVKLSLASALMLCLEFWYLMVLVVVTGLLPNPLIPVDAISICMNIEGWTAMISIGFNAAISVRVSNELGAGNAALAKFSVIVVSITSTLIGIVCMIVVLATKDSFPYLFTSSEAVAAETTRIAVLLGFTVLLNSLQPVLSGVAVGAGWQALVAYVNIACYYIIGLPAGLVLGFTLDLGVQGIWGGMVAGICLQTLILIGIIYFTNWNKEAEQAESRVQRWGGTAQE

SEQ ID NO: 586 - protein, 326 aa, Arabidopsis thaliana
MSAVLTAGGGLTAGDRSIITAINTGASSLSFVGSAFIVLCYCLFKELRKFSFKLVFYLALSDMLCSFFLIVGDPSKGFICYAQGYTTHFFCVASFLWTTTIAFTLHRTVVKHKTDVEDLEAMFHLYVWGTSLVVTVIRSFGNNHSHLGPWCWTQTGLKGKAVHFLTFYAPLWGAILYNGFTYFQVIRMLRNARRMAVGMSDRVDQFDNRAELKVLNRWGYYPLILIGSWAFGTINRIHDFIEPGHKIFWLSVLDVGTAALMGLFNSIAYGFNSSVRRAIHERLELFLPERLYRWLPSNFRPKNHLILHQQQQQRSEMVSLKTEDQQ

SEQ ID NO: 587 - protein, 386 aa, Arabidopsis thaliana
MVRASSSKKGGSKGGDKDDAESKQRKRLKTLALDNQLLSDSPAKSHSSLKPSKQVLKHHGTDIIRKSQRKNRFLFSFPGLLAPISAATIGDLDRLSTKNPVLYLNFPQGRMKLFGTILYPKNRYLTLQFSRGGKNVLCDDYFDNMIVFSESWWIGTKEENPEEARLDFPKELAQVDTFHLFLHFLFKTMVATEMFNMIRRILWFQAENTEFDFQGGAGGAASVKKLASPEIGSQPTETDSPEVDNEDVLSEDGEFLDDKIQVTPPVQLTPPVQVTPVRQSQRNSGKKFNFAETSSEASSGESEGNTSDEDEKPLLEPESSTRSREESQDGNGITASASKLPEELPAKREKLKSKDSKLVQATLSNLFKKAEEKTAGTSKAKSSSKA

SEQ ID NO: 588 - protein, 240 aa, Arabidopsis thaliana
MAMSHLFLSSSPQSSLALRLHSTTQFTLSYSKNNKDCSFQSANEAKVSKRSLLCRAIHMESGHSGEQPKKLNFDNLLRRTKHVWDNSPQPVKEFPWNRAFGNFIQLVLDLAISVVKFLFVPILAVSSISEMSYCAHERKLALVPFPLVIGMVVAGVLQETALKISPRLKEAEVPWHLIAMMMFFTLIKLPGPYYPYWGRLLVPHFANGVLLRALWSMFFWYKKTRNTSGNPLQNHSLETE

SEQ ID NO: 589 - protein, 716 aa, Arabidopsis thaliana
MASNSLLRSSSNFFLGSHIIISSPTPKTTRKPSFPFSFVSRAKYQITRSSQDENSPNGKPNSPFSSQVALAAILLSSISSSPLALAVVDEPASPSVVIESQAVKPSTPSPLFIQNEILKAPSPKSSDLPEGSQWRYSEFLNAVKKGKVERVRFSKDGSVVQLTAVDNRRASVIVPNDPDLIDILAMNGVDISVSEGESSGNDLFTVIGNLIFPLLAFGGLFLLFRRAQGGPGGGPGGLGGPMDFGRSKSKFQEVPETGVSFADVAGADQAKLELQEVVDFLKNPDKYTALGAKIPKGCLLVGPPGTGKTLLARAVAGEAGVPFFSCAASEFVELFVGVGASRVRDLFEKAKSKAPCIVFIDEIDAVGRQRGAGMGGGNDEREQTINQLLTEMDGFSGNSGVIVLAATNRPDVLDSALLRPGRFDRQVTVDRPDVAGRVKILQVHSRGKALGKDVDFDKVARRTPGFTGADLQNLMNEAAILAARRELKEISKDEISDALERIIAGPEKKNAVVSEEKKRLVAYHEAGHALVGALMPEYDPVAKISIIPRGQAGGLTFFAPSEERLESGLYSRSYLENQMAVALGGRVAEEVIFGDENVTTGASNDFMQVSRVARQMIERFGFSKKIGQVAVGGPGGNPFMGQQMSSQKDYSMATADIVDAEVRELVEKAYKRATEIITTHIDILHKLAQLLIEKETVDGEEFMSLFIDGQAELYIS

SEQ ID NO: 590 - protein, 568 aa, Arabidopsis thaliana
MNSNNWLAFPLSPTHSSLPPHIHSSQNSHFNLGLVNDNIDNPFQNQGWNMINPHGGGGEGGEVPKVADFLGVSKSGDHHTDHNLVPYNDIHQTNASDYYFQTNSLLPTVVTCASNAPNNYELQESAHNLQSLTLSMGSTGAAAAEVATVKASPAETSADNSSSTTNTSGGAIVEATPRRTLETFGQRTSIYRGVTRHRWTGRYEAHLWDNSCRREGQSRKGRQVYLGGYDKEEKAARAYDLAALKYWGPSTTTNFPITNYEKEVEEMKNMTRQEFVASIRRKSSGFSRGASMYRGVTRHHQHGRWQARIGRVAGNKDLYLGTFSTEEEAAEAYDIAAIKFRGLNAVTNFEINRYDVKAILESNTLPIGGGAAKRLKEAQALESSRKREEMIALGSNFHQYGAASGSSSVASSSRLQLQPYPLSIQQPFEHLHHHQPLLTLQNNNDISQYHDSFSYIQTQLHLHQQQTNNYLQSSSHTSQLYNAYLQSNPGLLHGFVSDNNNTSGFLGNNGIGIGSSSTVGSSAEEEFPAVKVDYDMPPSGGATGYGGWNSGESAQGSNPGGVFTMWNE

SEQ ID NO: 591 - protein, 145 aa, Arabidopsis thaliana
MASFATIAAVQPSAAVKGLGGSSLAGAKLFIKPSRQSFKTKSTRAGAVVAKYGDKSVYFDLEDLGNTTGQWDVYGSDAPSPYNPLQSKFFETFAAPFTKRGLLLKFLILGGGSLLTYVSANSTGDVLPIKRGPQEPPKLGPRGKL

SEQ ID NO: 592 - protein, 317 aa, Arabidopsis thaliana
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 593 - protein, 391 aa, Arabidopsis thaliana; identical to SEQ ID NO: 163

SEQ ID NO: 594 - protein, 160 aa, Arabidopsis thaliana
MATSASALLSPTTFSTAISHKNPNSISFHGLRPLRLGGSSSALPKLSTTGRKSSSAVVRAELSPSIVISLSTGLSLFLGRFVFFNFQRENVAKQGLPEQNGKTHFEAGDDRAKEYVSLLKSNDPIGFNIVDVLAWGSIGHIVAYYILATSSNGYDPSFFG

SEQ ID NO: 595 - protein, 132 aa, Arabidopsis thaliana
MPVMNPSLCIGTQTSVYLAPREKSFTSNGNSQRRYPTSVSMQRQPWSQSKFPSLQDAVQPVVVSKNKRPVFACNSALNSKCSQGQTQTVTRQSPTITQAPTHGKLFHPLLYVEQLFCVSNKQEGLKKPYDSS

SEQ ID NO: 596 - protein, 574 aa, Arabidopsis thaliana
MAANFCGLTLQSPFLYNFSRPTIRSSSFIRSSSSSSASSNGNLKEPFSGEPEADVVVIGSGIGGLCCGALLARYDQDVIVLESHDHPGGAAHSFEIKGYKFDSGPSLFSGLQSRGPQANPLAQVLDALGESFPCKKYDSWMVYLPEGDFLSRIGPTDFFKDLEKYAGPSAVQEWEKLLGAILPLSSAAMALPPLSIRGDLGVLSTAAARYAPSLLKSFIKMGPKGALGATKLLRPFSEIVDSLELKDPFIRNWIDLLAFLLAGVKSDGILSAEMIYMFAEWYKPGCTLEYPIDGTGAVVEALVRGLEKFGGRLSLKSHVENIVIENGKAVGVKLRNGQFVRARKAVVSNASMWDTLKLLPPGALPESYVKGVNTTPQCESFMHLHLGFDAEGIADDLEIHHIVVNDWDRGVDADQNVVLISVPSVLSPNLAPPGKHVLHAYCPGTEPFGLWEGLDRRSAEYKNLKSQRSEVMWRAVERALGLGFKREKCEVSLVGTPLTHQRFLRRNRGTYGPAIEAGKGTFPGHSTPIPQLLCCGDSTFPGIGVPAVAASGAIVANSLVPVSKHSQLLDAIGL

SEQ ID NO: 597 - protein, 543 aa, Arabidopsis thaliana
MAVSSAFVGCPKLETLLNHHNLSPSSSSSSSVSQTPLGLNGVRVLPKNNRTRRGLIQKARCELSASSDSASNAASISALEQLKNSAADRYTKERSSIVVIGLSIHTAPVEMREKLAIPEAEWPRAIAELCGLNHIEEAAVLSTCNRMEIYVLALSQHRGVKEVTEWMSKTSGIPVSEICQHRFLLYNKDATQHIFEVSAGLDSLVLGEGQILAQVKQVVKVGQGVNGFGRNISGLFKHAITVGKRVRTETNIASGAVSVSSAAVELALMKLPQSSNVSARMCVIGAGKMGKLVIKHLMAKGCTKVVVVNRSEERVSAIREEMPGIEIIYRPLDEMLACASEADVVFTSTASETPLFLKEHVENLPQASPEVGGLRHFVDISVPRNVGSCVGEVETARVYNVDDLKEVVAANKEDRMRKAMEAQTIITEESTQFEAWRDSLETVPTIKKLRAYAERIRVAELEKCMSKMGDDINKKTTRAVDDLSRGIVNRFLHGPMQHLRCDGSDSRTLSETLENMHALNRMYGLEKDILEEKLKAMAEQQQK

SEQ ID NO: 598 - protein, 231 aa, Arabidopsis thaliana
MAKDGGVSCLRRSEMIGIGIGELESPPLDSDQVHVLAVDDSLVDRIVIERLLRITSCKVTAVDSGWRALEFLGLDDDKAAVEFDRLKVDLIITDYCMPGMTGYELLKKIKESTSFKEVPVVIMSSENVMTRIDRCLEEGAEDFLLKPVKLADVKRLRSYLTRDVKVAAEGNKRKLTTPPPPPPLSATSSMESSDSTVESPLSMVDDEDSLTMSPESATSLVDSPMRSPGLA

SEQ ID NO: 599 - protein, 382 aa, Arabidopsis thaliana
MVNFVSLCDIKYGFVPKNSTDLFVKRKIHKLPSRGDVITRLPVFGSNARENLNAKPRRNLRVRPIFCKSYGDAAKVYQEEEIPRAKLIWRAIKLPMYSVALVPLTVGASAAYLETGLFLARRYVTLLLSSILIITWLNLSNDVYDFDTGADKNKMESVVNLVGSRTGTLAAAITSLALGVSGLVWTSLNASNIRAILLLASAILCGYVYQCPPFRLSYQGLGEPLCFAAFGPFATTAFYLLLGSSSEMRHLPLSGRVLSSSVLVGFTTSLILFCSHFHQVDGDLAVGKYSPLVRLGTEKGAFVVRWTIRLLYSMLLVLGLTRILPLPCTLMCFLTLPVGNLVSSYVEKHHKDNGKIFMAKYYCVRLHALLGAALSLGLVIAR

SEQ ID NO: 600 - protein, 277 aa, Arabidopsis thaliana
MGMGTSTFVIRWVNLLTMLLAVAVIIFGVWMSTHNDGCRRSLTFPVIALGGFIFLISIIGFLGACKRSVALLWIYLAVLLIVLIAILVFTVLAFIVTNNGSGHTNPGLRYKEYKLNDYSSWFLKQLNNTSNWIRLKSCLVKSEQCRKLSKKYKTIKQLKSAELTPIEAGCCRPPSECGYPAVNASYYDLSFHSISSNKDCKLYKNLRTIKCYNCDSCKAGVAQYMKTEWRLVAIFNVVLFVVLISSLLSTRFDSEQSFGLLNVNGLLCWMLCEKKCC

SEQ ID NO: 601 - protein, 223 aa, Arabidopsis thaliana
MATSSTQLLLSSSSLFHSQITKKPFLLPATKIGVWRPKKSLSLSCRPSASVSAASSAVDVNESVTSEKPTKTLPFRIGHGFDLHRLEPGYPLIIGGIVIPHDRGCEAHSDVDAILGALGLPDIGQIFPDSDPKWKGAASSVFIKEAVRLMDEAGYEIGNLDATLILQRPKISPHKETIRSNLSKLLGADPSVVNLKAKTHEKVDSLGENRSIAAHTVILLMKK

SEQ ID NO: 602 - protein, 815 aa, Arabidopsis thaliana
MDEVSTVNENENRKTMIEPKKLNKRKREPTAIENLTSEEKESQISSLNLEMKGLFDYFREVMDKSKRTDLFSGFSECSSLNSMVALLMEEMSLPLSKLVDEIYLKLKEKTESVTMVAVKSAVVSVGQRVSYGVLNVDADVLEDDSESCLWCWETRDLKIMPSSVRGVLKLRRTCRKKIHERITAVSAMLAALQREETEKLWRSDLSKAAEKLGKILSEVDIRSFMDNMMQKNSSEMAEKDSKREEKLLLKQLEKNRCEAEKEKKRMERQVLKEKLQQEKEQKLLQKAIVDENNKEKEETESRKRIKKQQDESEKEQKRREKEQAELKKQLQVQKQASIMERFLKKSKDSSLTQPKLPSSEVTAQELSCTKHENEIGKVVQAIDNAFSTTCEATVDDIRREHFASWRQLGHLLSSSKKHWGMRRQPKSELFPKLKLSTNSGVTSDGEPNMEKQGDGCEENNFDGRQCKPSSSNRKKSRRVKQLLQFDKSCRPGFYGIWPSQSQVVKPRRPLQKDPELDYEVDSDEEWEEEEAGESLSDCEKDEDESLEEGCSKADDEDDSEDDFMVPDGYLSEDEGVQVDRMDIDPSEQDANTTSSKQDQESPEFCALLQQQKHLQNLTDHALKKTQPLIICNLTHEKVSLLAAKDLEGTQKVEQICLRALMVRQFPWSSLIEISINDIQDEDQEASKFSCSQSTPPSNSKAKIIPDSDLLTVVSTIQSCSQGINRVVETLQQKFPDVPKTKLRQKVREISDFEDSRWQVKKEVLTKLGLSPSPDKGGKRLPKTISTFFSKRCLPPSTKPQPAVEDAAERLENENA

SEQ ID NO: 603 - protein, 417 aa, Arabidopsis thaliana
MALNVSKVVPNSPILVKSVNASRSRRVLLAYVHHPLAANKGSSIEELKQGLCCTKTVTFVSSRRCSTLCFVGKSQDTETNSQVVQKEGEKQVMPRRKSSNSSQLLVEYVSNDAKFVNERARNDFVLLSRGIMRLDARARQDVAILGSGFLKLDARAREDTEKIDRDVKRKAERLHHIATIFKNIAESKLKNAADKHWSDGALEADLRRADFRAKQRAMEDALMALEFIKNIHDMMVNKMVDSLVTSETGTTDRISLEKNGIALGFFPGEVSSDRISAIEEAYKSMASALSEADGIDYTDPEELELLVTTLIDLDAMDGKSSASLLAECSSSPDVNTRKALANALAAAPSMWTLGNAGMGALQRLAEDSNPAIAAAASRAINALKKQWEVEEGDSLRFMMNFERPNDDDDVDSDLDEI

SEQ ID NO: 604 - protein, 329 aa, Arabidopsis thaliana
MTKLGRRNDGGGKSHRSSTKRQRRTSVSVDDPSPGEEEEKTLVVLTDDSDSEEDDKPLGDVLRTCRKRRVSSPKSVTLPNSNVLECPNCFDPLKKPIFQCNNGHLACFLCCIKLKKRCSFCKLPIGDVRCRAMEKVIKAGLVSCSNAIYGCKQSTTYGNQLQSHEKVCVFAPCSCPIKDCNYIGFYKDLINHFRATHKVSPGDINSFVFDRPVIFGLDLDSSDKMVIFVEEKQGNLFVVQGFIGSHGVYATVSHIAPMVPEVRKFSCSLARLRPYSTLRLGLEVKNIQKLRSQEEQPQEDFLLIPSYMVNGDHMKMEISIGDKNDYTHI

SEQ ID NO: 605 - protein, 433 aa, Arabidopsis thaliana
MLRAKHIGKNYSSSLSPVLSPEHKPSLLESQAIGTVATAQANFMRVIVQDVANSVTSDDDNDSSKTGVELLCVVRAVLKKIRRRVLVGDKVLVGSIDWVDRRGMIENVFHRRSEILDPPVANVDHLLVLFSLDQPKLEPFTLTRFLVEAESTRIPLTLALNKTELISEEELETWKIRLRGWNYEPLFCSVGTKDGLDDIAFVLRDQTSVIVGPSGVGKSSLINVLRSNHGGGVVEDENWFEPMLGNKWFDDQRVGEVSSRSGRGKHTTRNVSLLPVSEGGYLADTPGFNQPSLLKVTKHSLAHCFPEIRNMIESEKCGFRDCLHIGEPGCVVKGDWERYPYYLQLLDEIRIREEFQLRTFGTKREDDVRYKVGDMGVKHAEPRLMPKKHRRESRKKTKQTMISELDEFEDEDSDLYIENDPIVQAIENENKRQ

SEQ ID NO: 606 - protein, 189 aa, Arabidopsis thaliana
MAAAMATATKCMSLNPSPPKLQNQTKSKPFISLPTPPKPNVSLAVTSTALAGAVFSSLSYSEPALAIQQIAQLAAANASSDNRGLALLLPIVPAIAWVLYNILQPAINQVNKMRESKGIVVGLGIGGGLAASGLLTPPPEAYAAAEAAAASSDSRGQLLLIVVTPALLWVLYNILQPALNQINKMRSGD

SEQ ID NO: 607 - protein, 84 aa, Arabidopsis thaliana
MVLLGLLGDWETKHEMESVEDPSKEKPSWRILNVPGKPPKLAWGHSTCVVGGTRVLVLGGHNGEEWILNELHELCLASWQDSDL

SEQ ID NO: 608 - protein, 253 aa, Arabidopsis thaliana
MRHEENYLDLNNLPDDFSKDGNKQALEEGSSSGQRKKKGSKEGKDESGKVYECRFCSLKFCKSQALGGHMNRHRQERETETLNQARQLVYRNDTITPPGISPFGYHHTTDPTIYRSVYSSPMIYPGSSSTNLVPQPPMPPPPPPYPYSSNQYSPHNHFNDYYLNPSFRGSRSISPSPNLPTTTTVDYMADSPVEPGYTCVGAPIGPTGFPIRGPSIVRAPLEPPQGRDGDASRQRLDHSLRFPINRFQDHHSL

SEQ ID NO: 609 - protein, 1371 aa, Arabidopsis thaliana
MLNRETEVSNFLRDEANINAVWASAIIEECTRLGLTYFCVAPGSRSSHLAIAAANHPLTTCLACFDERSLAFHAIGYAKGSLKPAVIITSSGTAVSNLLPAVVEASEDFLPLLLLTADRPPELQGVGANQAINQINHFGSFVRFFFNLPPPTDLIPVRMVLTTVDSALHWATGSACGPVHLNCPFRDPLDGSPTNWSSNCLNGLDMWMSNAEPFTKYFQVQSHKSDGVTTGQITEILQVIKEAKKGLLLIGAIHTEDEIWASLLLAKELMWPVVADVLSGVRLRKLFKPFVEKLTHVFVDHLDHALFSDSVRNLIEFDVVIQVGSRITSKRVSQMLEKCFPFAYILVDKHPCRHDPSHLVTHRVQSNIVQFANCVLKSRFPWRRSKLHGHLQALDGAIAREMSFQISAESSLTEPYVAHMLSKALTSKSALFIGNSMPIRDVDMYGCSSENSSHVVDMMLSAELPCQWIQVTGNRGASGIDGLLSSATGFAVGCKKRVVCVVGDISFLHDTNGLAILKQRIARKPMTILVINNRGGGIFRLLPIAKKTEPSVLNQYFYTAHDISIENLCLAHGVRYVHVGTKSELEDALFVPSVEEMDCIVEVESSINANAIVHSTLERFARQAAENSLGIVSASSFLHPMIKNVLLCQVSGIQYSQYRVKLCDRPTICSDEFSQFHREGFILSLTLEDGSIGYGEVAPLNSNVENLMDVEGQLQLVLHLMNEAKFSYMLPLLNGSISSWIWSELGITASSIFPSVRCGLEMALLNAMAVRHDSSLLGILHYQKEENGSAQPHSVQICALLDSEGTPLEVAYVARKLVQEGFSAIKLKVGRRVSSVQDALVMQEVRRAVGVQIELRADANCRWTFEEAREFGLLVNSCNLKYIEEPVQNKDDLIRFHEETGLPVALDETLDDFEECPLRMLTKYTHPGIVAVVIKPSVVGGFENAALIARWAQQHGKMAVISAAYESGLGLSAYILFASYLEMENVKASTEQKQGTPPSVAHGLGTYRWLSEDVMMNTLGIFRSPYSGFVEGFIADASRNLKDVKINNDVIVRTSKGIPVRRYELRVDVDGFSHFIRVHDVGENAEGSVALFLHGFLGTGEEWIPIMTGISGSARCISVDIPGHGRSRVQSHASETQTSPTFSMEMIAEALYKLIEQITPGKVTIVGYSMGARIALYMALRFSNKIEGAVVVSGSPGLKDPVARKIRSATDDSKARMMVDNGLYIFIENWYNGGLWKSLRNHPHFSKIAASRLLHGDVPSVAKLLSDLSSGRQPSLWEELEDCDTNISLVFGEKDVKYKQIATRMYREMSKSKKSVNNIIEIVEIPEAGHAVHLESPLRVILALRKFLTRVHNSSTETELSQKLLLALKEM

SEQ ID NO: 610 - protein, 455 aa, Arabidopsis thaliana
MDVSMSFSQDMDNEYEKLIRRMNPPRVVIDNDSCKKATVIRVDSANEYGILLEVVQILTDLNLTITKAYISSDGGWFMDVFNVTDQDGNKVTDEVVLDYIQKSLGPEACFSTSMRSVGVIPSTDSTVIELTGCDRPGLLSELSAVLTHLKCSVLNAEIWTHNTRAAAVMQVTDDLTGCGISDPERLSRIKNLLRNVLKGSNTPREAKTVVSHGEVHTDRRLHQMMFEDRDYEHRLVDDDSSIQDERQRPDVCVDNWLDKDYSVVTVRCKDRPKLLFDTVCTLTDMQYVVFHGSVDTEGTEAFQEYYVRHIDGSPVKSEAEKQRVIQCLEAAIKRRVSEGLKLELCTTDRVGLLSNVTRIFRENSLTVTRAEVKTKGGKALNTFYVSDASGYSIDAKTIDSIRQTIGQTILKVKNNPQEQQQRQKSPSHESPTRFLFGGLFKSKSFVNFGLVRSYS

SEQ ID NO: 611 - protein, 990 aa, Arabidopsis thaliana
MEEKTHHHHHSTNKHIPSSKSRTPLLHKPYHHHVQTNPPPFLLHPSSHQNLNLVASNLPSSYYYYYYCYFYSQFHNSLPPPPPPHLLPLSPPLPPLLPLPPPHSMTRFHKSLPVSQVVERKQQHQQKKKIQVSNNKVSGSIAIEEAALVVAKRPDFGGQDGSVIYLLANHFLVKFDSSQRIYHYNVEISPQPSKEIARMIKQKLVETDRNSFSGVVPAFDGRQNIYSPVEFQGDRLEFFVNLPIPSCKAVMNYGDLREKQPQKKIEKLFRVNMKLVSKFDGKEQRKEGEDWAPLPPEYIHALDVILRENPMEKCTSIGRSFYSSSMGGSKEIGGGAVGLRGFFQSLRHTQQGLALNMDLSITAFHESIGVIAYLQKRLEFLTDLPRNKGRELSLEEKREVEKALKNIRVFVCHRETVQRYRVYGLTEEITENIWFPDREGKYLRLMSYFKDHYGYEIQFKNLPCLQISRARPCYLPMELCMICEGQKFLGKLSDDQAAKIMKMGCQKPNERKAIIDKVMTGSVGPSSGNQTREFNLEVSREMTLLKGRILQPPKLKLDRPRNLKESKVFKGTRIERWALMSIGGSSDQKSTIPKFINELTQKCEHLGVFLSKNTLSSTFFEPSHILNNISLLESKLKEIQRAASNNLQLIICVMEKKHKGYGDLKRISETRIGVVTQCCLYPNITKLSSQFVSNLALKINAKIGGSMTELYNSIPSHIPRLLRPDEPVIFMGADVTHPHPFDDCSPSVAAVVGSINWPEANRYVSRMRSQTHRQEIIQDLDLMVKELLDDFYKAVKKLPNRIIFFRDGVSETQFKKVLQEELQSIKTACSKFQDYNPSITFAVVQKRHHTRLFRCDPDHENIPPGTVVDTVITHPKEFDFYLCSHLGVKGTSRPTHYHILWDENEFTSDELQRLVYNLCYTFVRCTKPISIVPPAYYAHLAAYRGRLYIERSSESNGGSMNPSSVSRVGPPKTIPLPKLSDNVKNLMFYC

SEQ ID NO: 612 - protein, 339 aa, Arabidopsis thaliana
MRSYRFSDYLHMSVSFSNDMDLFCGEDSGVFSGESTVDFSSSEVDSWPGDSIACFIEDERHFVPGHDYLSRFQTRSLDASAREDSVAWILKVQAYYNFQPLTAYLAVNYMDRFLYARRLPETSGWPMQLLAVACLSLAAKMEEILVPSLFDFQVAGVKYLFEAKTIKRMELLVLSVLDWRLRSVTPFDFISFFAYKIDPSGTFLGFFISHATEIILSNIKEASFLEYWPSSIAAAAILCVANELPSLSSVVNPHESPETWCDGLSKEKIVRCYRLMKAMAIENNRLNTPKVIAKLRVSVRASSTLTRPSDESSFSSSSPCKRRKLSGYSWVGDETSTSN

SEQ ID NO: 613 - protein, 358 aa, Arabidopsis thaliana
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQRLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 614 - protein, 531 aa, Arabidopsis thaliana
MKAESSNESFIIGQRVHSLNDSRRVGTVKYVGDVEGYSGTWIGVDWDQDGDGKHNGSVNGVFYFNGRSQSSASFVRSQNLSRGITLLQALELRYRTISTKDEEDEMYVLSAGNRRVSIQLLGGDKIQDKLSRFEELTSASLSYLGVSSLGVSSDLGSILPNLKLLDLTGNLISDWEEIGALCEQLPALTTLNLSCNSLSSDIKSLPQLKNIRVLVLNNSGLSWTQVEILRRSLPGIEELHLMGNMISTITSTSSSDDQAFNSLRLLNLDDNCISDWSEVLKLSQLPCLEQLYLNKNKLSRIFQSVNGTESSEKGSDPFPSLSCLLLGANNIGDLASVDALNGFPQLVDIRLSENPISDPVRGGVPRFVLVARLTKVQVLNGSEVRAREKKDSEIRYVRMVMSKLNDKSGEIELLHPRFYELKKLHGIEDERASAENSGPKNIASGLISITLKCVGPSMGEKPHLTKKLPGSITVGKLKILSENFFKLKSIKPRLFLQEEGSPFPTALDDETATLLDVGICDGSTLLVDEES

SEQ ID NO: 615 - protein, 622 aa, Arabidopsis thaliana
MITAADFYHVMTAMVPLYVAMILAYGSVKWWKIFTPDQCSGINRFVALFAVPLLSFHFIAANNPYAMNLRFLAADSLQKVIVLSLLFLWCKLSRNGSLDWTITLFSLSTLPNTLVMGIPLLKGMYGNFSGDLMVQIVVLQCIIWYTLMLFLFEYRGAKLLISEQFPDTAGSIVSIHVDSDIMSLDGRQPLETEAEIKEDGKLHVTVRRSNASRSDIYSRRSQGLSATPRPSNLTNAEIYSLQSSRNPTPRGSSFNHTDFYSMMASGGGRNSNFGPGEAVFGSKGPTPRPSNYEEDGGPAKPTAAGTAAGAGRFHYQSGGSGGGGGAHYPAPNPGMFSPNTGGGGGTAAKGNAPVVGGKRQDGNGRDLHMFVWSSSASPVSDVFGGGGGNHHADYSTATNDHQKDVKISVPQGNSNDNQYVEREEFSFGNKDDDSKVLATDGGNNISNKTTQAKVMPPTSVMTRLILIMVWRKLIRNPNSYSSLFGITWSLISFKWNIEMPALIAKSISILSDAGLGMAMFSLGLFMALNPRIIACGNRRAAFAAAMRFVVGPAVMLVASYAVGLRGVLLHVAIIQAALPQGIVPFVFAKEYNVHPDILSTAVIFGMLIALPITLLYYILLGL

SEQ ID NO: 616 - protein, 467 aa, Arabidopsis thaliana
MATTVTLKSFTGLRQSSTEQTNFVSHVPSSLSLPQRRTSLRVTAARATPKLSNRKLRVAVIGGGPAGGAAAETLAQGGIETILIERKMDNCKPCGGAIPLCMVGEFNLPLDIIDRRVTKMKMISPSNIAVDIGRTLKEHEYIGMVRREVLDAYLRERAEKSGATVINGLFLKMDHPENWDSPYTLHYTEYDGKTGATGTKKTMEVDAVIGADGANSRVAKSIDAGDYDYAIAFQERIRIPDEKMTYYEDLAEMYVGDDVSPDFYGWVFPKCDHVAVGTGTVTHKGDIKKFQLATRNRAKDKILGGKIIRVEAHPIPEHPRPRRLSKRVALVGDAAGYVTKCSGEGIYFAAKSGRMCAEAIVEGSQNGKKMIDEGDLRKYLEKWDKTYLPTYRVLDVLQKVFYRSNPAREAFVEMCNDEYVQKMTFDSYLYKRVAPGSPLEDIKLAVNTIGSLVRANALRREIEKLSV

SEQ ID NO: 617 - protein, 144 aa, Arabidopsis thaliana
MAVSLPNSFLQISPCVPSLQLRKPVMAAVKGGKQSVRRSSNTVVQITCRKKELHPEFHEDAKVYCNGELVMTTGGTKKEYVVDVWSGNHPFYLGNRSALMVDADQVEKFRKRFAGLSEIMEIPVLKGEIIMPTKKSKGPKGKKK

SEQ ID NO: 618 - protein, 327 aa, Arabidopsis thaliana
MALFQEKLSSLSSSYSSIHSLPRILVSKPRNRIAVTKSRSICRASWQELAGVLVFSAIPFTAVKAIANSSIGVSLRRRLEEKKKEAVENSSRFKSKAQEARNDSKWYGKERPRWFGPIPYDYPPYLTGELPGDYGFDIAGLGKDRLTFDKYFNFEILHARWAMLAALGALIPEVFDLTGTFHFAEPVWWRVGYSKLQGETLEYLGIPGLHVAGSQGVIVIAICQVLLMVGPEYARYCGIEALEPLGIYLPGDINYPGGTLFDPLNLSEDPVAFEDLKVKEIKNGRLAMVAWLGFYAQAAFTGKGPVQNLVDHVSDPLHNNLIAMLQT

SEQ ID NO: 619 - protein, 196 aa, Arabidopsis thaliana
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 620 - protein, 585 aa, Arabidopsis thaliana
MSPPSATAGDINHREVDPTIWRACAGASVQIPVLHSRVYYFPQGHVEHCCPLLSTLPSSTSPVPCIITSIQLLADPVTDEVFAHLILQPMTQQQFTPTNYSRFGRFDGDVDDNNKVTTFAKILTPSDANNGGGFSVPRFCADSVFPLLNFQIDPPVQKLYVTDIHGAVWDFRHIYRGTPRRHLLTTGWSKFVNSKKLIAGDSVVFMRKSADEMFIGVRRTPISSSDGGSSYYGGDEYNGYYSQSSVAKEDDGSPKKTFRRSGNGKLTAEAVTDAINRASQGLPFEVVFYPAAGWSEFVVRAEDVESSMSMYWTPGTRVKMAMETEDSSRITWFQGIVSSTYQETGPWRGSPWKQLQITWDEPEILQNVKRVNPWQVEIAAHATQLHTPFPPAKRLKYPQPGGGFLSGDDGEILYPQSGLSSAAAPDPSPSMFSYSTFPAGMQGARQYDFGSFNPTGFIGGNPPQLFTNNFLSPLPDLGKVSTEMMNFGSPPSDNLSPNSNTTNLSSGNDLVGNRGPLSKKVNSIQLFGKIITVEEHSESGPAESGLCEEDGSKESSDNETQLSLSHAPPSVPKHSNSNAGSSSQG

SEQ ID NO: 621 - protein, 241 aa, Arabidopsis thaliana
MAVLCSSSTVILSSSSVKSSGSERKSPFLGFSLTAISKPSVRVGIYANSKRGLQVKCEAEPTTTTSLVPANQRWMFDEEEANGPDIWNTTWYPKASDHVNTDKPWFVVDATDKILGRLASTIANHIRGKNLASYTPSVDMGAFVIVVNAEKVAVSGKKRNQKLYRRHSGRPGGMTVETFDQLQQRIPERIVEHAVRGMLPKGRLGRALFNHLKVYKGPDHPHEAQKPLDLPIRDKRIQLQK

SEQ ID NO: 622 - protein, 496 aa, Arabidopsis thaliana
MARYEFFRQIFIVLSIVSPLVRSFTVITSDSTAPSALIDGPQTGFTMTNDGARTEPDEQDAVYDIMRATGNDWAAAIPDVCRGRWHGIECMPDQDNVYHVVSLSFGALSDDTAFPTCDPQRSYVSESLTRLKHLKALFFYRCLGRAPQRIPAFLGRLGSSLQTLVLRENGFLGPIPDELGNLTNLKVLDLHKNHLNGSIPLSFNRFSGLRSLDLSGNRLTGSIPGFVLPALSVLDLNQNLLTGPVPPTLTSCGSLIKIDLSRNRVTGPIPESINRLNQLVLLDLSYNRLSGPFPSSLQGLNSLQALMLKGNTKFSTTIPENAFKGLKNLMILVLSNTNIQGSIPKSLTRLNSLRVLHLEGNNLTGEIPLEFRDVKHLSELRLNDNSLTGPVPFERDTVWRMRRKLRLYNNAGLCVNRDSDLDDAFGSKSGSTVRLCDAETSRPAPSGTVQHLSREEDGALPDGATDVSSTSKSLGFSYLSAFFLVFPNFIFMLISS

SEQ ID NO: 623 - protein, 461 aa, Arabidopsis thaliana
MGKENAVSGNSIPIHGRPVTRALASALRASSKLITSSEVAATTQNQGRVLRAKSKRTALDEKKANAPKKRAVLKDITNVTCENSYTSCFSVAVENIKQIKKGRQSSSSSKVASSSATSQVTDAKVEVVSNSAGASLSVFTDTSLGTNETSYSIIAKPSSRSPPRPFGTVERSCGGASSPKFVDIDSDDKDPLLCSLYAPDIYYNLRVAELKRRPFPDFMEKTQRDVTETMRGILVDWLVEVSEEYTLVPDTLYLTVYLIDWFLHGNYVERQRLQLLGITCMLIASKYEEIHAPRIEEFCFITDNTYTRDQVLEMESQVLKHFSFQIYTPTSKTFLRRFLRAAQVSFPNQSLEMEFLANYLTELTLMDYPFLKFLPSIIAASAVFLAKWTLNQSSHPWNPTLEHYTTYKASDLKASVHALQDLQLNTKGCSLNSIRMKYRQDKFKSVAVFSSGELPDKLFIS

SEQ ID NO: 624 - protein, 616 aa, Arabidopsis thaliana
MITWHDLYTVLTAVVPLYVAMILAYGSVQWWKIFSPDQCSGINRFVAIFAVPLLSFHFISTNDPYAMNFRFVAADTLQKIIMLVLLALWANLTKNGSLEWMITIFSLSTLPNTLVMGIPLLIAMYGTYAGSLMVQVVVLQCIIWYTLLLFLFEYRGAKLLIMEQFPETGASIVSFKVESDVVSLDGHDFLETDAEIGNDGKLHVTVRKSNASRRSLMMTPRPSNLTGAEIYSLSSTPRGSNFNHSDFYSVMGFPGGRLSNFGPADLYSVQSSRGPTPRPSNFEENNAVKYGFYNNTNSSVPAAGSYPAPNPEFSTGTGVSTKPNKIPKENQQQLQEKDSKASHDAKELHMFVWSSSASPVSDVFGGGAGDNVATEQSEQGAKEIRMVVSDQPRKSNARGGGDDIGGLDSGEGEREIEKATAGLNKMGSNSTAELEAAGGDGGGNNGTHMPPTSVMTRLILIMVWRKLIRNPNTYSSLIGLIWALVAYRWHVAMPKILQQSISILSDAGLGMAMFSLGLFMALQPKIIACGNSVATFAMAVRFITGPAIMAVAGIAIGLHGDLLRIAIVQAALPQGIVPFVFAKEYNVHPTILSTGVIFGMLIALPITLVYYILLGL

SEQ ID NO: 625 - protein, 772 aa, Arabidopsis thaliana
MKLTHNFSFLLLLLLVHMSSKHILASKDSSSYVVYFGAHSHVGEITEDAMDRVKETHYDFLGSFTGSRERATDAIFYSYTKHINGFAAHLDHDLAYEISKHPEVVSVFPNKALKLHTTRSWDFLGLEHNSYVPSSSIWRKARFGEDTIIANLDTGVWPESKSFRDEGLGPIPSRWKGICQNQKDATFHCNRKLIGARYFNKGYAAAVGHLNSSFDSPRDLDGHGSHTLSTAAGDFVPGVSIFGQGNGTAKGGSPRARVAAYKVCWPPVKGNECYDADVLAAFDAAIHDGADVISVSLGGEPTSFFNDSVAIGSFHAAKKRIVVVCSAGNSGPADSTVSNVAPWQITVGASTMDREFASNLVLGNGKHYKGQSLSSTALPHAKFYPIMASVNAKAKNASALDAQLCKLGSLDPIKTKGKILVCLRGQNGRVEKGRAVALGGGIGMVLENTYVTGNDLLADPHVLPATQLTSKDSFAVSRYISQTKKPIAHITPSRTDLGLKPAPVMASFSSKGPSIVAPQILKPDITAPGVSVIAAYTGAVSPTNEQFDPRRLLFNAISGTSMSCPHISGIAGLLKTRYPSWSPAAIRSAIMTTATIMDDIPGPIQNATNMKATPFSFGAGHVQPNLAVNPGLVYDLGIKDYLNFLCSLGYNASQISVFSGNNFTCSSPKISLVNLNYPSITVPNLTSSKVTVSRTVKNVGRPSMYTVKVNNPQGVYVAVKPTSLNFTKVGEQKTFKVILVKSKGNVAKGYVFGELVWSDKKHRVRSPIVVKL

SEQ ID NO: 626 - protein, 650 aa, Arabidopsis thaliana
MASSHSLLFSSSFLSKPSSFTSSLRRFVYLPTRQFWPRQRHGFSTVFAVATEPAISSSGPKKAEPSTVVLPSNESSDKLLKIRHTCAHVMAMAVQKLFPDAKVTIGPWIDNGFYYDFDMEPLTDKDLKRIKKEMDRIISRNLPLLREEVSREEAKKRIMAINEPYKMEILDGIKEEPITVYHIGNEWWDLCAGPHVETTGKINKKAVELESVAGAYWRGDEKRQMLQRIYGTAWESEEQLKAYLHFKEEAKRRDHRRIGQDLDLFSIQDEAGGGLVFWHPKGAIVRNIIEESWKKMHVEHGYDLIYTPHVAKADLWKISGHLDFYRENMYDQMEIEDELYQLRPMNCPYHILLYQRKRQSYRDLPIRVAELGTVYRYELSGSLHGLFRVRGFTQDDAHIFCLEDQIKDEIRGVLDLTEEILSRFGFNKYEVNLSTRPEKSVGGDDIWEKATCALRDALDDKGWSYEVDEGGGAFYGPKIDLKIEDALGRKWQCSTIQVDFNLPQRFDITYVDTNSDKKRPIMIHRAVLGSLERFFGVLIEHYAGDFPLWLSPVQVRVLPVTDNQLEFCKEVSKKLRACGVRAELCHGERLPKLIRNAETQKIPLMAVVGPKEVETGTVTVRSRFGGELGTIPVDDLINKINIAVETRTAL

SEQ ID NO: 627 - protein, 133 aa, Arabidopsis thaliana
MAAASISAIGCNQTLIGTSFYGGWGSSISGEDYQTMLSKTVAPPQQARVSRKAIRAVPMMKNVNEGKGLFAPLVVVTRNLVGKKRFNQLRGKAIALHSQVITEFCKSIGADAKQRQGLIRLAKKNGERLGFLA

SEQ ID NO: 628 - protein, 1923 aa, Arabidopsis thaliana; identical to SEQ ID NO: 97

SEQ ID NO: 629 - protein, 702 aa, Arabidopsis thaliana
MPALAFVDTPIDTFSSIFTPSSVSTAVVDGSCHWSPSLSSSLYRIDGWGAPYFAANSSGNISVRPHGSNTLPHQDIDLMKVVKKVTDPSGLGLQLPLIVRFPDVLKNRLECLQSAFDYAIQSQGYDSHYQGVYPVKCNQDRFIIEDIVEFGSGFRFGLEAGSKPEILLAMSCLCKGNPEAFLVCNGFKDSEYISLALFGRKLELNTVIVLEQEEELDLVIDLSQKMNVRPVIGLRAKLRTKHSGHFGSTSGEKGKFGLTTVQILRVVRKLSQVGMLDCLQLLHFHIGSQIPSTALLSDGVAEAAQLYCELVRLGAHMKVIDIGGGLGIDYDGSKSGESDLSVAYSLEEYAAAVVASVRFVCDQKSVKHPVICSESGRAIVSHHSVLIFEAVSAGQQHETPTDHQFMLEGYSEEVRGDYENLYGAAMRGDRESCLLYVDQLKQRCVEGFKEGSLGIEQLAGVDGLCEWVIKAIGASDPVLTYHVNLSVFTSIPDFWGIDQLFPIVPIHKLDQRPAARGILSDLTCDSDGKINKFIGGESSLPLHEMDNNGCSGGRYYLGMFLGGAYEEALGGVHNLFGGPSVVRVLQSDGPHGFAVTRAVMGQSSADVLRAMQHEPELMFQTLKHRAEEPRNNNNKACGDKGNDKLVVASCLAKSFNNMPYLSMETSTNALTAAVNNLGVYYCDEAAAGGGGKGKDENWSYFG

SEQ ID NO: 630 - protein, 429 aa, Arabidopsis thaliana
MVNSCENKIFVKPTSTTILQDETRSRKFGQEMKREKRRVLRVINQNLAGARVYPCVVNKRGSLLSNKQEEEEGCQKKKFDSLRPSVTRSGVEEETNKKLKPSVPSANDFGDCIFIDEEEATLDLPMPMSLEKPYIEADPMEEVEMEDVTVEEPIVDIDVLDSKNSLAAVEYVQDLYAFYRTMERFSCVPVDYMMQQIDLNEKMRAILIDWLIEVHDKFDLINETLFLTVNLIDRFLSKQNVMRKKLQLVGLVALLLACKYEEVSVPVVEDLVLISDKAYTRNDVLEMEKTMLSTLQFNISLPTQYPFLKRFLKAAQADKKCEVLASFLIELALVEYEMLRFPPSLLAATSVYTAQCTLDGSRKWNSTCEFHCHYSEDQLMECSRKLVSLHQRAATGNLTGVYRKYSTSKFGYIAKCEAAHFLVSESHHS

SEQ ID NO: 631 - protein, 258 aa, Arabidopsis thaliana [sequence omitted]

SEQ ID NO: 632 - protein, 744 aa, Arabidopsis thaliana
MEAMLVDCVNNSLRHFVYKNAIFMCERLCAEFPSEVNLQLLATSYLQNNQAYSAYHLLKGTQMAQSRYLFALSCFQMDLLNEAESALCPVNEPGAEIPNGAAGHYLLGLIYKYTDRRKNAAQQFKQSLTIDPLLWAAYEELCILGAAEEATAVFGETAALSIQKQYMQQLSTSLGLNTYNEERNSTSTKNTSSEDYSPRQSKHTQSHGLKDISGNFHSHGVNGGVSNMSFYNTPSPVAAQLSGIAPPPLFRNFQPAVANPNSLITDSSPKSTVNSTLQAPRRKFVDEGKLRKISGRLFSDSGPRRSSRLSADSGANINSSVATVSGNVNNASKYLGGSKLSSLALRSVTLRKGHSWANENMDEGVRGEPFDDSRPNTASTTGSMASNDQEDETMSIGGIAMSSQTITIGVSEILNLLRTLGEGCRLSYMYRCQEALDTYMKLPHKHYNTGWVLSQVGKAYFELIDYLEAEKAFRLARLASPYCLEGMDIYSTVLYHLKEDMKLSYLAQELISTDRLAPQSWCAMGNCYSLQKDHETALKNFLRAVQLNPRFAYAHTLCGHEYTTLEDFENGMKSYQNALRVDTRHYNAWYGLGMIYLRQEKLEFSEHHFRMAFLINPSSSVIMSYLGTSLHALKRSEEALEIMEQAIVADRKNPLPMYQKANILVCLERLDEALEVLEELKEYAPSESSVYALMGRIYKRRNMHDKAMLHFGLALDMKPPATDVAAIKAAMEKLHVPDEIDESP

SEQ ID NO: 633 - protein, 641 aa, Arabidopsis thaliana
MLLHCNVSYYTSTFSFISSSLRRQDNADDSQDTVIRRRHNARSISLYIRHNRDLKLNKNPNESQETFVPPPPPPRRDLDGENRSKLLELSLVTRRTPQFPGSIYAQSASDADIASSLPSLRNFLGSDGDDDGESEREMIVKALEIRRKVTKEIIKESLVRKGRFGITYATNVTDRLGDFVDHVMIQAAALKRLPEFSESRFNLRARTVIEDSNFVPLVRWLKHHELSYNRIAKIICMSKGNLDSIRIMIEWLKSIHVKGEFIAVAFLRSGDNILQRNREELNEIVEYLESNGVRRDWMGYVVGRCPELLSFSMEEVKSRVDFFLKMGMNQNDFGTMVYDYPKIIGFFSFQVMEKKINYLKEFGLSTEEVGRLLAYKPHLMGCSIEERWKPLVKYFYYLGIPKEGMKRILVVKPILYCIDLEKTIAPKVRFLQEMGIPNEAIGNMLVKFPSLLTNSLYKKIRPVVIFLLTRAGVTQKDIGKVIAMDPALLGCSIGTKLEPNMRYYISLGIRFYQLGEMIADFPMLLRYNVDNLRPKYRYLRRTMIRPLQDLIEFPRFFSYSLERRIIPRHTIMVENRVNFKLRYMLACTDEEFERRVRDKVERRERFEAGLDSEDSQPSDENISDQEIAFSDEAEEEEDLTE

SEQ ID NO: 634 - protein, 530 aa, Arabidopsis thaliana
MDLGVRVSGHETVSSPGQTELGSGFSNKQERSGFDGEDCWRSSKLSRTSTDGFSSSPASAKTLSFHQGIPLLRSTTINDPRKGQEHMLSFSSASGKSDVSPYLQYCRNSGYGLGGMMNTSNMHGNLLTGVKGPFSLTQWAELEQQALIYKYITANVPVPSSLLLSLKKSFFPYGSLPPNSFGWGSFHLGFSGGNMDPEPGRCRRTDGKKWRCSRDAVPDQKYCERHINRGRHRSRKPVEGQNGHNTNAAAAASAAAASTAAAVSKAAAGTSAVAMRGSDNNNSLAAAVGTQHHTNNQSTDSLANRVQNSRGASVFPATMNLQSKETHPKQSNNPFEFGLISSDSLLNPSHKQASYATSSKGFGSYLDFGNQAKHAGNHNNVDSWPEELKSDWTQLSMSIPMAPSSPVQDKLALSPLRLSREFDPAIHMGLGVNTEFLDPGKKTNNWIPISWGNNNSMGGPLGEVLNSTTNSPKFGSSPTGVLQKSTFGSLSNSSSASSTIIGDNNNKNGDGKDPLGPTTLMNTSATAPSL

SEQ ID NO: 635 - protein, 300 aa, Arabidopsis thaliana
MVLLLRYRSLTINLTPLIPKSQKFHTLQSFRNPNFISIPKISASTNNPTTTTNRSISDATKFAKSVLFIPPGVEIEELTDDMVLPGSNIVIGPFAGHSQIKEVEFVKSSARARDCPKDDRPEIAILGRSNVGKSSLINCLVRKKEVALTSKKPGKTQLINHFLVNKSWYIVDLPGYGFAKVSDAAKTDWSAFTKGYFLNRDSLVCVLLLIDASVPPQKIDLDCANWLGRNNVPMTFVFTKCDKMKATKGKRPDENIKAFQQIIRENFKVHPPWILTSSVSGLGRDELLLHMSQLRNYWDQ

SEQ ID NO: 636 - protein, 191 aa, Arabidopsis thaliana
MVRKYRKAKGIVEAGVSSTYMQLRSRRIVYVRSEKSSSVSVVGDNGVSSSCSGSNEYKKKELIHLEEEDKDGDTETSTYRRGTKRKLFENLREEEKEELSKSMENYSSEFESAVKESLDCCCSGRKTMEETVTAEEEEKAKLMTEMPTESEIEDFFVEAEKQLKEKFKKKYNFDFEKEKPLEGRYEWVKLE

SEQ ID NO: 637 - protein, 2146 aa, Arabidopsis thaliana
MSLRLQNPFLSTPLLHGSFNRREKRINVARRAFRSKRIYSEKKQNDWLAKVAKFSQFCGKNVQLLRKSLDSRSRMEVKCLKEPFVRSKDLVRSLAPVWEEGLFFLRCSVFFAVISGVCLLVWYGQNKARVFVETKLLPSVCSVLSETIQREVDFGKVRRVSPLCITLEASSIGPHGEEFSCGEVPTMKVCVRPFASLRRGKIVVDAILSNPTVLVAQKKDFTWLGIPLSDTTLPSHLSSEEGIDFRTKTRRVSREEAGIRWDEERDNDARKAAEIGYIVPCKNYSQAKDNAVKHDRRFTEIANPNSFICMDEKMHSAEQHCMDPGVEYDVKHAELEKSFGIKIPGSGLKFLSKMLKVPRKYKFKWNSKSHKNSMSNISAKKRILERSASAALSYFHSLSQQKLDEPSVLSTNYDGLSLDMLLVKGDREISNQYDRHVPYGEQSLANDLDGKGYRVRGKRLLGVKKASTLDKFTVSCDPFLMTVDRLCALLQTKRSPSVEDIVNSSESETLSSQRGDISMNVVNQNTDDVPHGNRSGNQPRDFTFKKHEHQPVANHWRPSWPRNKKLKEAVFNILTGSSKKLTGRADPNAPHLSDELEKLPAVYVEKTLPVMLDSVQFKGGTLLLLAYGDTEPREMRNVHGHVKFQNHYGRVYVQLGGNCNMWRSDVTSEDGGLLSVDVFVDTVEQNWHANLNVANFFVPVHLCMSRGESFPNLHGQLDVTGLGFHINDAPSSFSDVSASLSFRGQRIFLHNANGWFGKVPLEASGDFGIHPDEGEFHLMCQVPYVEINALMKTFKMKPLFFPLAGSVTAVFNCQGPLDAPVFVGSCMVSRKIAYLSPDLPTSLAYEAMLKNKEAGAVAAFDRVPFSYLSANFTFNTDNCVADLYGIRATLVDGGEIRGAGNAWICPEGEVDDTALDVNFSGNISFDKVLHRYMPEYFNIGMLKLGDLTGETKLSGALLKPRFDIKWAAPKADGSLTDARGDIVISHDNIIVNSSSVAFDLFTKLDTSYHDPCLSHQDFTQGEAMPFVVEGLDLDLRMRGFEFFSLVSSYPFDSPRPTHLKATGRIKFLGKIKRHSTTKDGDVGSDKCEDAAAISSLDGDISISSLKLNQLILAPQLSGRLSVSRDHVKLDAAGRPDESLTLDFIGPLQPNSDENVQSGKLLSFSLQKGQLRANACFQPQQSATLEIRNFPLDELELASLRGLIQKAEIQLNLQKRRGHGLLSVIRPKFSGVLGEALDVAVRWSGDVCFMLSGRLEVMITVEKTILEQSNSRYELQGEYVLPGSRDRDLGQKEAGSFLMRAMTGHLGSVISSMGRWRMRLEVPKAEVAEMLPLARLLSRSTDPAVHSRSKDLFIQSVQNLCLQAENLRDLLEEIRGYYTPPSEVVLEDLSLPGLAELKGHWHGSLDASGGGNGDTLAEFDFHGDDWEWGTYKTQRVLATGSYNNDDGLRLKEMLIQKGNATLHADGTLLGPKTNLHFAVLNFPVSLIPTLVEVVESSATDIVHSLRKLLSPIKGILHMEGDLRGSLEKPECDVQVRLLDGAVGGIDLGRAEVFASLTSNSRFLFNSNFEPFVQNGHVHIQGSVPVSFSQKNMSEGEVSETDRGGAVKIPSWAKEKEDDEKRTSRDRSEERWDSQLAESLKGLYWNILDAGEVRLEADIKDGGMTLLTAISPYANWLQGNADIRLQVGGTVDHPVLDGSASFHRASISSPVLRKPLTNFGGTLHVKSNRLCITSLESRVSRKGKLVVKGNLPLRSNEASAGDGIELKCEVLEVRAKNFLSCQVDTQLQITGSMLQPTISGNIKLSQGEAYLPHDKGGGAAPLNRLAANQYSIPGAAINQAVSSRYFARFFGTERASSGMKFSQSTGKSNSVEKEIEEVKMKPNMDIRLSDMKLVLGPELRIMYPLILNFAVSGELELDGMAHPKFIKPKGVLTFENGDVNLVATQVRLKREHLNVAKFEPEHGLDPLLDLALVGSEWQFRVQSRASNWQDKLVVTSTRSVEQDALSPSEAAKVFESQLAESILEGDGQLAFKKLATATLGTIMPRIEGKGEFGQARWRLVYAPQIPSLLSVDPTVDPLKSLASNISFGTEVEVQLGKRLQASVVRQMKDSEMAMQWTLIYQLTSRLRVLLQSAPSKRLLFEYSATSQD

SEQ ID NO: 638 - protein, 412 aa, Arabidopsis thaliana
MGHATSLSHFLILSSSRFSRLGSLTRLLSKPTSLSGSFSSISVTGQGFRCCCSVATDDTSPSVKKRVVSGVQPTGSVHLGNYLGAIKNWVALQDTYETLFIIVDHHAITLPYDTRQLGKATTDTAALYLACGIDVSKASVFVQSHVPAHVELMWLLCSSTPIGWLQKMIQFKEKSRKEGVENASVGLFTYPDLMTADILLYQSDFVPVGEDQKQHIELAREIAQRVNHLYGGKKWKKLGGYEIFRGGSLFKIPEPLIPQAGARVMSLTDGLSKMSKSAPSDQSRINLLDSKDLIVDKIKRCKTDSFAGLEFDNAERPECNNLLSIYQIVSGKKKEEVMEECKDMSWGTFKPLLADALIEHLSPIQARYQEIIAEPEYLDKILSEGADRAEELGAVTMRNMYQAMGYYQRRRY

SEQ ID NO: 639 - protein, 387 aa, Arabidopsis thaliana
MASSRVSDLPHQRGIAGEIKPKNVAGHGRQNRKVLGDIGNLVTGRDVATGKDVAKKAKQPQQQTKAEVIVISPDENEKCKPHFSRRTHIRGTKTFTATLRARSKAASGLKDAVIDIDAVDANNELAAVEYVEDIFKFYRTVEEEGGIKDYIGSQPEINEKMRSILIDWLVDVHRKFELMPETLYLTINLVDRFLSLTMVHRRELQLLGLGAMLIACKYEEIWAPEVNDFVCISDNAYNRKQVLAMEKSILGQVEWYITVPTPYVFLARYVKAAVPCDAEMEKLVFYLAELGLMQYPIVVLNRPSMLAASAVYAARQILKKTPFWTETLKHHTGYSEDEIMEHAKMLMKLRDSASESKLIAVFKKYSVSENAEVALLPSLDDFSVSCA

SEQ ID NO: 640 - protein, 761 aa, Arabidopsis thaliana
MRVPLIDFLRFLVLILSLSGASVAADATVKQNFNKYETDSGHAHPPPIYGAPPSYTTPPPPIYSPPIYPPPIQKPPTYSPPIYPPPIQKPPTPTYSPPIYPPPIQKPPTPTYSPPIYPPPIQKPPTPTYSPPIYPPPIQKPPTPSYSPPVKPPPVQMPPTPTYSPPIKPPPVHKPPTPTYSPPIKPPVHKPPTPIYSPPIKPPPVHKPPTPIYSPPIKPPPVHKPPTPTYSPPVKPPPVHKPPTPIYSPPIKPPPVHKPPTPIYSPPVKPPPVQTPPTPIYSPPVKPPPVHKPPTPTYSPPVKSPPVQKPPTPTYSPPIKPPPVQKPPTPTYSPPIKPPPVKPPTPIYSPPVKPPPVHKPPTPIYSPPVKPPPVHKPPTPIYSPPVKPPPIQKPPTPTYSPPIKPPPLQKPPTPTYSPPIKLPPVKPPTPIYSPPVKPPPVHKPPTPIYSPPVKPPPVHKPPTPTYSPPIKPPPVKPPTPTYSPPVQPPPVQKPPTPTYSPPVKPPPIQKPPTPTYSPPIKPPPVKPPTPTYSPPIKPPPVHKPPTPTYSPPIKPPPIHKPPTPTYSPPIKPPPVHKPPTPTYSPPIKPPPVHKPPTPTYSPPIKPPPVHKPPTPTYSPPIKPPPVHKPPTPTYSPPIKPPPVHKPPTPTYSPPIKPPPVQKPPTPTYSPPVKPPPVQLPPTPTYSPPVKPPPVQVPPTPTYSPPVKPPPVQVPPTPTYSPPIKPPPVQVPPTPTTPSPPQGGYGTPPPYAYLSHPIDIRN

SEQ ID NO: 641 - protein, 87 aa, Arabidopsis thaliana
MGQIQYSEKYFDDTFEYRHVVLPPEVAKLLPKNRLLSENEWRAIGVQQSRGWVHYAVHRPEPHIMLFRRPLNYQQQQENQAQNMLVK

SEQ ID NO: 642 - protein, 83 aa, Arabidopsis thaliana
MGQIQYSDKYFDDTFEYRHVVLPPEVAKLLPKNRILSESEWRAIGVQQSRGWVHYAIHRPEPHIMLFRRPLNYQQEHQAQIAK

SEQ ID NO: 643 - protein, 586 aa, Arabidopsis thaliana
MASANALSSASVLCSSRQSKLGGGNQQQGQRVSYNKRTIRRFSVRANVKEIAFDQHSRAALQAGIDKLADCVGLTLGPRGRNVVLDEFGSPKVVNDGVTIARAIELPNAMENAGAALIREVASKTNDSAGDGTTTASILAREIIKHGLLSVTSGANPVSLKRGIDKTVQGLIEELQKKARPVKGRDDIRAVASISAGNDDLIGSMIADAIDKVGPDGVLSIESSSSFETTVEVEEGMEIDRGYISPQFVTNPEKLLAEFENARVLITDQKITAIKDIIPILEKTTQLRAPLLIIAEDVTGEALATLVVNKLRGVLNVVAVKAPGFGERRKAMLQDIAILTGAEYLAMDMSLLVENATIDQLGIARKVTISKDSTTLIADAASKDELQARIAQLKKELFETDSVYDSEKLAERIAKLSGGVAVIKVGAATETELEDRKLRIEDAKNATFAAIEEGIVPGGGAALVHLSTVIPAIKETFEDADERLGADIVQKALLSPAALIAQNAGVEGEVVVEKIMFSDWENGYNAMTDTYENLFEAGVIDPAKVTRCALQNAASVAGMVLTTQAIVVDKPKPKAPAAAAPEGLMV

SEQ ID NO: 644 - protein, 482 aa, Arabidopsis thaliana; identical to SEQ ID NO: 103

SEQ ID NO: 645 - protein, 695 aa, Arabidopsis thaliana
MAASSACLVGNGLSVNTTTKQRLSKHFSGRQTSFSSVIRTSKVNVVKASLDGKKKQEGRRDFLKILLGNAGVGLVASGKANADEQGVSSSRMSYSRFLEYLDKDRVNKVDLYENGTIAIVEAVSPELGNRVERVRVQLPGLSQELLQKLRAKNIDFAAHNAQEDQGSVLFNLIGNLAFPALLIGGLFLLSRRSGGGMGGPGGPGNPLQFGQSKAKFQMEPNTGVTFDDVAGVDEAKQDFMEVVEFLKKPERFTAVGAKIPKGVLLIGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGVIVVAATNRADILDSALLRPGRFDRQVSVDVPDVKGRTDILKVHAGNKKFDNDVSLEIIAMRTPGFSGADLANLLNEAAILAGRRARTSISSKEIDDSIDRIVAGMEGTVMTDGKSKSLVAYHEVGHAVCGTLTPGHDAVQKVTLIPRGQARGLTWFIPSDDPTLISKQQLFARIVGGLGGRAAEEIIFGDSEVTTGAVGDLQQITGLARQMVTTFGMSDIGPWSLMDSSAQSDVIMRMMARNSMSEKLAEDIDSAVKKLSDSAYEIALSHIKNNREAMDKLVEVLLEKETIGGDEFRAILSEFTEIPPENRVPSSTTTTPASAPTPAAV

SEQ ID NO: 646 - protein, 805 aa, Arabidopsis thaliana
MDDEDVEIDLLTKSSNVDVFCEASTSGNVAQCATVSELRNGMDFESKEAAYYFYREYARSVGFGITIKASRRSKRSGKFIDVKIACSRFGTKREKATAINPRSCPKTGCKAGLHMKRKEDEKWVIYNFVKEHNHEICPDDFYVSVRGKNKPAGALAIKKGLQLALEEEDLKLLLEHFMEMQDKQPGFFYAVDFDSDKRVRNVFWLDAKAKHDYCSFSDVVLFDTFYVRNGYRIPFAPFIGVSHHRQYVLLGCALIGEVSESTYSWLFRTWLKAVGGQAPGVMITDQDKLLSDIVVEVFPDVRHIFCLWSVLSKISEMLNPFVSQDDGFMESFGNCVASSWTDEHFERRWSNMIGKFELNENEWVQLLFRDRKKWVPHYFHGICLAGLSGPERSGSIASHFDKYMNSEATFKDFFELYMKFLQYRCDVEAKDDLEYQSKQPTLRSSLAFEKQLSLIYTDAAFKKFQAEVPGVVSCQLQKEREDGTTAIFRIEDFEERQNFFVALNNELLDACCSCHLFEYQGFLCKHAILVLQSADVSRVPSQYILKRWSKKGNNKEDKNDKCATIDNRMARFDDLCRRFVKLGVVASLSDEACKTALKLLEETVKHCVSMDNSSKFPSEPDKLMTGGSIGLENEGVLDCASKVSKKKKIQKKRKVYCGPEDATNRSEELRQETEQVSSRAPTFENCYIPQANMEEPELGSRATTLGVYYSTQQTNQGFPSISSIQNGYYGHPPTIQAMGNLHSIHERMSQYETQPSMQGAGQTGFRGSAIRGCYDIEETLHDMTMGSSQFQGSDSSHPSDHRLSN

SEQ ID NO: 647 - protein, 671 aa, Arabidopsis thaliana
MDESLTPNPKQKPASTTTRIQAPTSPFFLGSNDDRLEREQARAARAAASRRRSVIFARGSQPETESDPCFDKQQILELFQNCIKLASENKINQKNTWELNLIDHLCEIIKVEDENNTETNFQKASCTLEAGVKIYSMRVDSVHSEAYKVLGGITRAGHDDGGDHEDAAGAVENATNQKKQPEKKISPLSTLEPSFDALNVKKFDVAFAVDPLYHQTSAQFDEGGAKGLLLNNLGVYGGCQVLFDSQEIPGKLVSSANKHDKSETIDLSFVKECVEQMVLNMRKKDEIVPSLRAIINQFDEENQRPSDTFSCGQQTTESFDISHGNDASYADDDEGYENFGTSFDYEGQSGDVDENFGPNEAEPIYSNFHEEVEPASLQDMDSDDRLENVDDYLFLSLGISSKQNSWAGPDHWKYRKTKGPDVQPASEIKSSPPAKKTRKKKQAEPELDFAKALEEEMPDIFAPPKNPKTLLLPASRTPCQTKLPEDCHYQPENLIKLFLLPNVMCLGRRRRKNSGETSRQQPDDYEHGESWGNDNVYDDDDGPFDDNENDQSDAEDTNTLISQPRQVNKIDVQYDKASKQVDVQVLKETLWECLQESHQPPIQDEEHQQEPPESRSFKVLLASFPDDCQAAERTQDISPHLCFICLLHLANEHNLSLIGSQNLDDLTIHLA

SEQ ID NO: 648 - protein, 266 aa, Arabidopsis thaliana
MEKRSSIKNRGVLRLPPGFRFHPTDEELVVQYLRRKVTGLPLPASVIPETDVCKSDPWDLPGDCESEMYFFSTREAKYPNGNRSNRSTGSGYWKATGLDKQIGKKKLVVGMKKTLVFYKGKPPNGTRTNWVLHEYRLVDSQQDSLYNMNWVLCRVFLKKRSNSNSKRKEDEKEEVENEKETETEREREEENKKSTCPIFYDFMRKDTKKKRRRRRCCDLNLTPATCCCCSSSTSSSSVCSSALTHTSSNDNRQEISYRENKFCLFL

SEQ ID NO: 649 - protein, 131 aa, Arabidopsis thaliana
MSMRRSKAEGKRSLRELSEEEEEEEETEDEDTFEEEEALEKKQKGKATSSSGVCQVESCTADMSKAKQYHKRHKVCQFHAKAPHVRISGLHQRFCQQCSRFHALSEFDEAKRSCRRRLAGHNERRRKSTTD

SEQ ID NO: 650 - protein, 265 aa, Arabidopsis thaliana
MASSTMALSSPAFAGKAVKPAASDVLGSGRVTMRKTVAKPKGPSGSPWYGSDRVKYLGPFSGEPPSYLTGEFPGDYGWDTAGLSADPETFARNRELEVIHSRWAMLGALGCVFPELLARNGVKFGEAVWFKAGSQIFSDGGLDYLGNPSLVHAQSILAIWATQVILMGAVEGYRVAGDGPLGEAEDLLYPGGSFDPLGLATDPEAFAELKVKELKNGRLAMFSMFGFFVQAIVTGKGPLENLADHLADPVNNNAWAFATNFVPGK

SEQ ID NO: 651 - protein, 266 aa, Arabidopsis thaliana
MAASTMALSSPALTGKAVKLSPAASEVFGTGRITMRKASKPTGPSGSPWYGSDRVKYLGPFSGEPPSYLTGEFPGDYGWDTAGLSADPETFARNRELEVIHSRWAMLGALGCVFPELLARNGVKFGEAVWFKAGSQIFSDGGLDYLGNPSLVHAQSILAIWATQVILMGAVEGYRVAGDGPLGEAEDLLYPGGSFDPLGLATDPEAFAELKVKELKNGRLAMFSMFGFFVQAIVTGKGPLENLADHLADPVNNNAWAFATNFVPGK

SEQ ID NO: 652 - protein, 438 aa, Arabidopsis thaliana [sequence omitted]

SEQ ID NO: 653 - protein, 215 aa, Arabidopsis thaliana
MPVRVVESNTPAQVSGTDPGNRSPLPPSSLLGAGQAFSGTQNVSNQQKEEAWRVNVQIQGIDLEHGYLCGTMEALNVPMADTPVITFWEGEIVDGKNYTFYTGKWEATREDDMRHWSKFPSFSPLQGQVESDGGRQLDLNNYPYIFMRWKEQYFVNVGTDCGLTIAGFYYVCFSCSDGSISGFYYDPNSSPFQKLELKTVNEGRSGFSFSSYELQ

SEQ ID NO: 654 - protein, 432 aa, Arabidopsis thaliana
MAGCAMNLQFSSVVKVRNEISSFGICNRDFVFRDLAKAMKVPVLRIRGGSGRQRSRLFVVNMSQSPIEPQSGGFAATEQIKGEGDNSILGKDNVRNLGTDQLENLDIDGNVGDGFNGSDGNGGGGGGGNGGEGDGEGEDYEEKEFGPILKFEEVMKETEARGATLPSDMLEAAKNYGIRKVLLLRYLDLQSSAGLLGFAIRSWAMLRNRMLADPSFLFKIGAEIVIDSCCATVAEVQKRGKDFWAEFELYVADLLVGTVVNIALVGMLAPYVRFGQPSASPGFLGRMVFAYNALPSSVFEAERPGCRFSAQQRLATYFYKGIMYGAVGFGCGIVGQGIANLIMTAKRNINKSEENIPVPPLIKSAALWGVFLSVSSNTRYQIINGLERVVEASPFAKKFPPAAMAFTVGVRLANNIYGGMQFVDWARLSGCQ

SEQ ID NO: 655 - protein, 251 aa, Arabidopsis thaliana
MAATMIGINLSCFKSTSFFSPDLNSLQSKLSLLSLKPSPTQPRKSTVIRMGGGPRTFPGGVSKWQWKRMQAKKQKQLLKARLCRERQIYEMRKRAELKAAVAELERPWEPIHKPPNLFSVCADEQVKVLADRFQKPGGFDLWTDRDGPQLFESVDDLPSARFFPKGVVHSVKPYGRLSSSSVVDDGDESEVKDEEIGKKLRGRRVRKRGDDGGKRRTENRGNGGRLRNGGSSSSQVYDMTLQNDGRYEIGS

SEQ ID NO: 656 - protein, 839 aa, Arabidopsis thaliana
MEPNIYQLALAALFGASFVAVSGFFMHFKALNLVLERGKERKENPDGDEPQNPTLVRRRSQVRRKVNDQYGRSPASLPDATPFTDGGGGGGGDTGRSNGHVYVDEIPPGLPRLHTPSEGRASVHGASSIRKTGSFVRPISPKSPVASASAFESVEESDDDDNLTNSEGLDASYLQANGDNEMPADANEEQISMAASSMIRSHSVSGDLHGVQPDPIAADILRKEPEQETFVRLNVPLEVPTSDEVEAYKCLQECLELRKRYVFQETVAPWEKEVISDPSTPKPNTEPFAHYPQGKSDHCFEMQDGVVHVFANKDAKEDLFPVADATAFFTDLHHVLKVIAAGNIRTLCHRRLVLLEQKFNLHLMLNADKEFLAQKSAPHRDFYNVRKVDTHVHHSACMNQKHLLRFIKSKLRKEPDEVVIFRDGTYLTLREVFESLDLTGYDLNVDLLDVHADKSTFHRFDKFNLKYNPCGQSRLREIFLKQDNLIQGRFLGEITKQVFSDLEASKYQMAEYRISIYGRKMSEWDQLASWIVNNDLYSENVVWLIQLPRLYNIYKDMGIVTSFQNILDNIFIPLFEATVDPDSHPQLHVFLKQVVGFDLVDDESKPERRPTKHMPTPAQWTNAFNPAFSYYVYYCYANLYVLNKLRESKGMTTITLRPHSGEAGDIDHLAATFLTCHSIAHGINLRKSPVLQYLYYLAQIGLAMSPLSNNSLFLDYHRNPFPVFFLRGLNVSLSTDDPLQIHLTKEPLVEEYSIAASVWKLSACDLCEIARNSVYQSGFSHALKSHWIGKDYYKRGPDGNDIHKTNVPHIRVEFRDTIWKEEMQQVYLGKAVISDEVVP

SEQ ID NO: 657 - protein, 174 aa, Arabidopsis thaliana
MAVSSLSIRCGGFSPTISHKTEILCPNPSLKACCLLSSGAYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKEGGRWKELLHV

SEQ ID NO: 658 - protein, 474 aa, Arabidopsis thaliana
MLRFYHWRFPPSLAVVRMLSSPPPPHSHSPFSGGGVNSNSVGGNSKPELQFPQSQPHKLSSSPSSSLKSTVACSNAGAIRRSMATVSQAFSERTESIDSDLGSLVVVSFYKFADFPEHADFRKPLKDLCEKLRVSGGIILAPEGINGSICGIRESVEEVLAFIQRDVRLNGLRQVETPVSPEQEAIHHGHSSSSPLAAGEDAPFRWDHVRVKLKKEIVTLGIPSVSPIERVGTYVSPEEWNELISDPETVVIDVRNTYETRIGKFKGAVDPCTTAFRNFPSWVENQFALKQEGNETQAKVEKEDFSEITHKEDKAEKPKTLPRIAMYCTGGIRCEKASSLLLSQGFEEVYHLKGGILKYLEEVPKTESLWEGECFVFDKRVSVEHGLAQGTHKLCYGCKQPISDEDMEAPEYEYGVSCPYCYSKKSEEEKERARARQTQFEEWGVIGGPDKGRRPATKPDSPRKKINAKLGSSI

SEQ ID NO: 659 - protein, 822 aa, Arabidopsis thaliana
MATVTNFKLVTPPESSRADKPGATKASDAFQEKKSVSVNYDRGEHEVSVNIGGLRKADIPRRYRIRVENDRFQKDWSVSEVVDRLMALNRWEEVDGVLNSWVGRFARKNFPVLIRELSRRGCIELCVNVFKWMKIQKNYCARNDIYNMMIRLHARHNWVDQARGLFFEMQKWSCKPDAETYDALINAHGRAGQWRWAMNLMDDMLRAAIAPSRSTYNNLINACGSSGNWREALEVCKKMTDNGVGPDLVTHNIVLSAYKSGRQYSKALSYFELMKGAKVRPDTTTFNIIIYCLSKLGQSSQALDLFNSMREKRAECRPDVVTFTSIMHLYSVKGEIENCRAVFEAMVAEGLKPNIVSYNALMGAYAVHGMSGTALSVLGDIKQNGIIPDVVSYTCLLNSYGRSRQPGKAKEVFLMMRKERRKPNVVTYNALIDAYGSNGFLAEAVEIFRQMEQDGIKPNVVSVCTLLAACSRSKKKVNVDTVLSAAQSRGINLNTAAYNSAIGSYINAAELEKAIALYQSMRKKKVKADSVTFTILISGSCRMSKYPEAISYLKEMEDLSIPLTKEVYSSVLCAYSKQGQVTEAESIFNQMKMAGCEPDVIAYTSMLHAYNASEKWGKACELFLEMEANGIEPDSIACSALMRAFNKGGQPSNVFVLMDLMREKEIPFTGAVFFEIFSACNTLQEWKRAIDLIQMMDPYLPSLSIGLTNQMLHLFGKSGKVEAMMKLFYKIIASGVGINLKTYAILLEHLLAVGNWRKYIEVLEWMSGAGIQPSNQMYRDIISFGERSAGIEFEPLIRQKLESLRNKGEGLIPTFRHEGTLL

SEQ ID NO: 660 - protein, 305 aa, Arabidopsis thaliana
MAPGGSALKEALESNSTGVDYEVKMAKVEANSKPTKSGSGSIGKFHSSNGVYELLECPVCTNLMYPPIHQCPNGHTLCSSCKLRVQNTCPTCRYELGNIRCLALEKVAESLEVPCRYQNLGCQDIFPYYSKLKHEQHCRFRSYSCPYAGSECSVTGDIPTLVDHLKDDHKVDMHDGCTFNHRYVKSNPHEVENATWMLTVFNCFGRQFCLHFEAFQLGMAPVYMAFLRFMGDENEAKKFSYSLEVGAHSRKLTWQGIPRSIRDSHRKVRDSQDGLIIPRNLALYFSGSDKEELKLRVTGRIWKEE

SEQ ID NO: 661 - protein, 428 aa, Arabidopsis thaliana
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQPMEMLRFSSPAGQQSQQPSSVPTKTTDGSRLDH

SEQ ID NO: 662 - protein, 206 aa, Arabidopsis thaliana
MEDEDDPTTKNSNNTDDFAIEPREGIIFESEDAAKMFYDDYSRRLGFVMRVMSCRRSEKDGRILARRFGCNKEGHCVSIRGKFGSVRKPRPSTREGCKAMIHVKYDRSGKWVITKFVKEHNHPLVVSPREARHTLDEKDKRIQELTIELRNKKRLCAAYKEQLDAFAKIVEEHSNQIAKKVENVVNNLKEFEHLEHALLRSKQDAI

SEQ ID NO: 663 - protein, 286 aa, Arabidopsis thaliana
MLLRLCRHRLPLPLTLSSSVFFSKSSPVSSAFMDASNPNSSRKSNVSSFAQSSRRGGGYERDNDRRRPQGRGDGGGGKDRIDALGRLLTRILRHMATELRLNMRGDGFVKVEDLLNLNLKTSANIQLKSHTIDEIREAVRRDNKQRFSLIDENGELLIRANQGHSITTVESEKLLKPILSPEEAPVCVHGTYRKNLESILASGLKRMNRMHVHFSCGLPTDGEVISGMRRNVNVIIFLDIKKALEDGIAFYISDNKVILTEGIDGVLPVDYFQKIESWPDRQSIPF

SEQ ID NO: 664 - protein, 429 aa, Arabidopsis thaliana
MQSPKMEQEEVEEERMRNKWPWMKAAQLMEFRMQALVYRYIEAGLRVPHHLVVPIWNSLALSSSSNYNYHSSSLLSNKGVTHIDTLETEPTRCRRTDGKKWRCSNTVLLFEKYCERHMHRGRKRSRKLVESSSEVASSSTKYDNTYGLDRYNESQSHLHGTISGSSNAQVVTIASLPSARSCENVIRPSLVISEFTNKSVSHGRKNMEMSYDDFINEKEASMCVGVVPLQGDESKPSVQKFFPEVSDKCLEAAKFSSNRKNDIIARSREWKNMNVNGGLFHGIHFSPDTVLQERGCFRLQGVETDNEPGRCRRTDGKKWRCSKDVLSGQKYCDKHMHRGMKKKHPVDTTNSHENAGFSPLTVETAVRSVVPCKDGDDQKHSVSVMGITLPRVSDEKSTSSCSTDTTITDTALRGEDDDEEYLSLFSPGV

SEQ ID NO: 665 - protein, 1029 aa, Arabidopsis thaliana
MPVMERVAEETVATNNIQLKARVDDVPCNKLDARHNDMVIQSETANSDCPGSSAHRNVDLTKPPPPEEAAGAKLSVEELTLGNYRIVQGSNNTNVDSPRAGKFEHLYRLARGSAFRAGDGDLDSQPRDMDQMLSRIRQQLAGAPSERQNLKPFMSRRSDQNLEAFSERLRAAGENSIMNAPALISEGVQMKTPVSSSNFSQLLLKRAMKGKGVVGKNQETPPEFVSDQDLGSKEKKLDISKSPTPHDVLPLKSSPKGNGMVSHGDGNHSKSSIGISLREFLRSSYAKREKRHGLCLFRQLVELVDSAHSKRLFLLDLRPSLFTLVPSKKLRYIGNFGKNDLESDVDEDLNRRRPVVEESSSGGRDSKKRKMDLHLNSPGNQLQATSTGRPFKRKSPVIDLNMVDARNPDSCELQQQDYIKNLSVSSVSRKQSMSTWLEEQWYTCPEEINGEDIGEKSNIYALGVLLFELLCHCESGEMHAAMMADLRHRILPPTFLSKYPKEAGFCLWLLHPEPSSRPSARDILKSELICEDDSVKSTAAAEEISELLLHFLSSLEVQKKKKASKLLQDIQTLEDDIKEAERRYSSNVSLVRSHGAIEKRVQSSPLDEHCTTSSALFVPTANTDRLMSNIRQLEDAYFFMRSQINLSSSAATARSDKTLKDRDRCSENQNENQDMSTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSINEKRSLGTIWSPANVCCVQFSSYSNHLLAFGSADYKVYCYDLRYVKTPWCTLAGHEKAVSYVKFMDSETIVSASTDNSLKLWNLNKTNSSGLSPGACSLTYKGHTNQKNFVGLSVLDGYIACGSETNEVYSYYKSLPMPMTSYKFGSVDPISGNEYFDDNGQFVSSVCWRKKSNMLVAANSTGNMKLLKLV

SEQ ID NO: 666 - protein, 174 aa, Arabidopsis thaliana
MASLSVSSSSTIIDSRAPPSRLASASASSPSCISLPTLPIQSHTRAAKATAYCRKIVRNVVTRATTEVGEAPATTTEAETTELPEIVKTAQEAWEKVDDKYAIGSLAFAGVVALWGSAGMISAIDRLPLVPGVLELVGIGYTGWFTYKNLVFKPDREALFEKVKSTYKDILGSS

SEQ ID NO: 667 - protein, 307 aa, Arabidopsis thaliana
MAATSLVLTCASPLFSSPRVISATKKLTTELSISTAKFRRRCSGNNDEVLLEGMPPEYYDDREKTKELRRMQREEEEEEERKIEEYREIGTRLKEFPEQDLRKARKLVSSFIRAAEEVEERIEEAAEKGELDELVLMIIWNRLDLARRDDEKDAIRSLDLLYRRVETEILKRQASPAMKLLNDLLNMHDGFEDDAWLKDCRKRMAETFPREDPFSILMPPGFDIDMHQGQLRPPIETETDNTLLRVDFVREVDALLQEVRIEEDATTGSKGEGLDPEAIALKFKQQEKQRTIRQIEAILDLALNLKW

SEQ ID NO: 668 - protein, 347 aa, Arabidopsis thaliana
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 669 - protein, 511 aa, Arabidopsis thaliana
MAYATGITFASRSILPICSRTFLSPLRVASLLVFPEKSSATFFRRVQVPHLFSTSTTTLFSSVKCSIHSTSSPETENQAVFRPNVVDILEERGLLESITSENLRSACSDPKVAPLRVYCGFDPTAESLHLGNLLGIIVLSWFQRCGHQAVGLIGGATGRVGDPSGKSLERPELDADTLEKNIAGITKIIIKILGSNPSPGGSYVIFNNYDWWKDMTMLDFLNKVGRFARVGTMMAKESVKKRLESEQGMSYTEFTYQLLQAYDFLHLFKNEGINVQIGGSDQWGNITAGTDLIRKILQAEEAAYGLTFPLLLKNDGTKFGKSEDGAIWLSPSMLSPYKFYQYFFSVPDVDVIRFLKTLTFLSLDEIKILEDQMSKPGYVPNTAQIKLAEEVTRFVHGEEGLKEAIKATEALRPGAETKLDWNLIERIAEDIPSCSLPIDRVSGLSIVDLSVSAGLFESKSAARRMLKQGGFYMNNERVDDENKRVDEEDIVEGRGLVLSAGKKNKVVVRIS

SEQ ID NO: 670 - protein, 284 aa, Arabidopsis thaliana
MSASSLFNLPLIRLRSLALSSSFSSFRFAHRPLSSISPRKLPNFRAFSGTAMTDTKDAGMDAVQRRLMFEDECILVDETDRVVGHDSKYNCHLMENIEAKNLLHRAFSVFLFNSKYELLLQQRSNTKVTFPLVWTNTCCSHPLYRESELIQDNALGVRNAAQRKLLDELGIVAEDVPVDEFTPLGRMLYKAPSDGKWGEHELDYLLFIVRDVKVQPNPDEVAEIKYVSREELKELVKKADAGEEGLKLSPWFRLVVDNFLMKWWDHVEKGTLVEAIDMKTIHKL

SEQ ID NO: 671 - protein, 547 aa, Arabidopsis thaliana
MKRGYGETWDPPPKPLPASRSGEGPSMADKKKADDDNNNSNMDDELLAVLGYKVRSSEMAEVAQKLEQLEMVLSNDDVGSTVLNDSVHYNPSDLSNWVESMLSELNNPASSDLDTTRSCVDRSEYDLRAIPGLSAFPKEEEVFDEEASSKRIRLGSWCESSDESTRSVVLVDSQETGVRLVHALVACAEAIHQENLNLADALVKRVGTLAGSQAGAMGKVATYFAQALARRIYRDYTAETDVCAAVNPSFEEVLEMHFYESCPYLKFAHFTANQAILEAVTTARRVHVIDLGLNQGMQWPALMQALALRPGGPPSFRLTGIGPPQTENSDSLQQLGWKLAQFAQNMGVEFEFKGLAAESLSDLEPEMFETRPESETLVVNSVFELHRLLARSGSIEKLLNTVKAIKPSIVTVVEQEANHNGIVFLDRFNEALHYYSSLFDSLEDSYSLPSQDRVMSEVYLGRQILNVVAAEGSDRVERHETAAQWRIRMKSAGFDPIHLGSSAFKQASMLLSLYATGDGYRVEENDGCLMIGWQTRPLITTSAWKLA

SEQ ID NO: 672 - protein, 286 aa, Arabidopsis thaliana
MGREVVEVLMDRNADVSSARVHVAPKIAAEETDEEFEVKECTEEKSLSENAPNVGSAERVGAQKSPKTRNGNAKVSKQDAPLLAVRKPLQPENKKHIDDEDNCSIASSVATSMRMGKSGLTYGSAPTFRSAQRAEKRKEYYQKLEEKNQALEAERNELEQRQKDEQEAALKQLRKNLKFKAKPVPNFYYEAPPAKPELKKLPLTRPKSPKLILSRRKSFSDAVSSSSREEILKTVSNRNRHSTGTVQNKDDDHRNKNTNAAHDSPRVRSGKGKSGLKPVNESSEEA

SEQ ID NO: 673 - protein, 603 aa, Arabidopsis thaliana
MAASSTNARLTNPPRLLSKPRLSPTSVANLRFPAADFSTRFFADSSSPRLRSVPFPVVFSDQRRRRSMEPSNVYVASNSTEMEIGSHDIVKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRLLREAEESGAITVSGSEMFVRQAYEQFEIFTGLPAPKELYWQIMSKY

SEQ ID NO: 674 - protein, 486 aa, Arabidopsis thaliana
MASMSLSFSSSLCSSRIPEGKRRFRHRDVGIVRCVLAASKSSPGSVTKKRLWKDGEFPGITEPVNQRRTPIKNVKKKLDRRSKANGWVNTVTETLSDLIAKKQWLQALEVFDMLREQTFYQPKEGTYMKLLVLLGKSGQPNRAQKLFDEMLEEGLEPTVELYTALLAAYTRSNLIDDAFSILDKMKSFPQCQPDVFTYSTLLKACVDASQFDLVDSLYKEMDERLITPNTVTQNIVLSGYGRVGRFDQMEKVLSDMLVSTACKPDVWTMNIILSVFGNMGKIDMMESWYEKFRNFGIEPETRTFNILIGSYGKKRMYDKMSSVMEYMRKLEFPWTTSTYNNIIEAFADVGDAKNMELTFDQMRSEGMKADTKTFCCLINGYANAGLFHKVISSVQLAAKFEIPENTAFYNAVISACAKADDLIEMERVYIRMKERQCVCDSRTFEIMVEAYEKEGMNDKIYYLEQERQKLMDRTVATKEMENLPAG

SEQ ID NO: 675 - protein, 273 aa, Arabidopsis thaliana
MSLCLKIPLIKHQTTPEQNSAMASSSSSLLILAVACFVSLISPAISQQACKSQNLNSAGPFDSCEDLPVLNSYLHYTYNSSNSSLSVAFVATPSQANGGWVAWAINPTGTKMAGSQAFLAYRSGGGAAPVVKTYNISSYSSLVEGKLAFDFWNLRAESLSGGRIAIFTTVKVPAGADSVNQVWQIGGNVTNGRPGVHPFGPDNLGSHRVLSFTEDAAPGSAPSPGSAPAPGTSGSTTPGTAAGGPGNAGSLTRNVNFGVNLGILVLLGSIFIF

SEQ ID NO: 676 - protein, 232 aa, Arabidopsis thaliana
MAAITALTLRSPVYLPSSATSPRFHGFTNQPPPARLFFPLNPFPSLSIQNPKSIRISASASPITTPILQTEKSTARSSTLTGSTRSLATLAALAIAVTRVLAQKLSLAIQTSSPVIADGLRFSLSTAGPVFFASLRDRPPGYLNTPLTVVAVGIKKWLDIYSGVLMVRVLLSWFPNIPWERQPLSAIRDLCDPYLNLFRNIIPPIFDTLDVSPLLAFAVLGTLGSIVHGSTG

SEQ ID NO: 677 - protein, 217 aa, Arabidopsis thaliana
MEGNSLPEEDVEMMENSDVMKTVTDEASPMVEPFIGMEFESEEAAKSFYDNYATCMGFVMRVDAFRRSMRDGTVVWRRLVCNKEGFRRSRPRRSESRKPRAITREGCKALIVVKREKSGTWLVTKFEKEHNHPLLPLSPNVRRNFQLPQTPDEKDAKIRELSAELSRERRRCTALQQQLDMVLKEMEEHSNHLTININSVIQSVRDIESNTFTKQQT

SEQ ID NO: 678 - protein, 789 aa, Arabidopsis thaliana
MVSFSAPKKRRRGRSQRSMSSLNSLPVPNVGLLPGNSNFVSSSASSSGRFNVEVVNGSNQTVKSYPGIGDEIITINKEATTEALLALTAGFPADSLTEEEIEFGVVPIVGGIEQVNYILIRNHIISKWRENISSWVTKEMFLNSIPKHCSSLLDSAYNYLVTHGYINFGIAQAIKDKFPAQSSKSSVIIVGAGLSGLAAARQLMRFGFKVTVLEGRKRPGGRVYTKKMEANRVGAAADLGGSVLTGTLGNPLGIIARQLGSSLYKVRDKCPLYRVDGKPVDPDVDIKVEVAFNQLLDKASKLRQLMGDVSMDVSLGAALETFRQVSGNDVATEEMGLFNWHLANLEYANAGLVSKLSLAFWDQDDPYDMGGDHCFLPGGNGRLVQALAENVPILYEKTVQTIRYGSNGVKVTAGNQVYEGDMVLCTVPLGVLKNGSIKFVPELPQRKLDCIKRLGFGLLNKVAMLFPYVFWSTDLDTFGHLTEDPNYRGEFFLFYSYAPVAGGALLIALVAGEAAHKFETMPPTDAVTRVLHILRGIYEPQGINVPDPLQTVCTRWGGDPFSLGSYSNVAVGASGDDYDILAESVGDGRLFFAGEATTRRYPATMHGAFVTGLREAANMAQSAKARGIRKRIDRNPSRNAHSCAILLADLFRDPDLEFGSFCIIFSRRNPDPKSPAILRVTLSEPRKRNEDPKADQHSNKILFQQLQSHFNQQQQIQVYTLLTRQQALDLREVRGGDEKRLYYLCETLGVKLVGRKGLGVGADSVIASIKAERTGRKLPSSSTSGTKSG

SEQ ID NO: 679 - protein, 338 aa, Arabidopsis thaliana
MAGVNLQLRHAYSIAQFVPTVSSPPPLPTQRVRLGTSPSRVLLCNLRANSAAAPILRTTRRSVIVSASSVSSAVDSDSLVEDRDDVGRIPLLEVRDLRAVIAESRQEILKGVNLVVYEGEVHAVMGKNGSGKSTFSKVLVGHPDYEVTGGSIVFKGQNLLDMEPEDRSLAGLFMSFQSPVEIPGVSNMDFLNMAFNARKRKLGQPELDPIQFYSHLVSKLEVVNMKTDFLNRNVNEGFSGGERKRNEILQLAVLGAELAILDEIDSGLDVDALQDVAKAVNGLLTPKNSVLMITHYQRLLDYIKPTLIHIMENGRIIKTGDNSLAKLLEKEGYKAISG

SEQ ID NO: 680 - protein, 639 aa, Arabidopsis thaliana
MVKETLIPPSSTSMTTGTSSSSSLSMTLSSTNALSFLSKGWREVWDSADADLQLMRDRANSVKNLASTFDREIENFLNNSARSAFPVGSPSASSFSNEIGIMKKLQPKISEFRRVYSAPEISRKVMERWGPARAKLGMDLSAIKKAIVSEMELDERQGVLEMSRLRRRRNSDRVRFTEFFAEAERDGEAYFGDWEPIRSLKSRFKEFEKRSSLEILSGFKNSEFVEKLKTSFKSIYKETDEAKDVPPLDVPELLACLVRQSEPFLDQIGVRKDTCDRIVESLCKCKSQQLWRLPSAQASDLIENDNHGVDLDMRIASVLQSTGHHYDGGFWTDFVKPETPENKRHVAIVTTASLPWMTGTAVNPLFRAAYLAKAAKQSVTLVVPWLCESDQELVYPNNLTFSSPEEQESYIRKWLEERIGFKADFKISFYPGKFSKERRSIFPAGDTSQFISSKDADIAILEEPEHLNWYYHGKRWTDKFNHVVGIVHTNYLEYIKREKNGALQAFFVNHVNNWVTRAYCDKVLRLSAATQDLPKSVVCNVHGVNPKFLMIGEKIAEERSRGEQAFSKGAYFLGKMVWAKGYRELIDLMAKHKSELGSFNLDVYGNGEDAVEVQRAAKKHDLNLNFLKGRDHADDALHK

SEQ ID NO: 681 - protein, 397 aa, Arabidopsis thaliana
MMSLSGSSGRTIGRPPFTPTQWEELEHQALIYKYMVSGVPVPPELIFSIRRSLDTSLVSRLLPHQSLGWGCYQMGFGRKPDPEPGRCRRTDGKKWRCSREAYPDSKYCEKHMHRGRNRARKSLDQNQTTTTPLTSPSLSFTNNNNPSPTLSSSSSSNSSSTTYSASSSSMDAYSNSNRFGLGGSSSNTRGYFNSHSLDYPYPSTSPKQQQQTLHHASALSLHQNTNSTSQFNVLASATDHKDFRYFQGIGERVGGVGERTFFPEASRSFQDSPYHHHQQPLATVMNDPYHHCSTDHNKIDHHHTYSSSSSSQHLHHDHDHRQQQCFVLGADMFNKPTRSVLANSSRQDQNQEEDEKDSSESSKKSLHHFFGEDWAQNKNSSDSWLDLSSHSRLDTGS

SEQ ID NO: 682 - protein, 316 aa, Arabidopsis thaliana
MAALIRCCSSFSHTSGGQPPPRDKSRAPEIGKFATSIGYSVVRKPGDHPPFSKIIHSSSQPKERQGKGILQTPFASVGSLDKFSAFEGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 683 - protein, 420 aa, Arabidopsis thaliana
MSDDQFHHPPPPSSMRHRSTSDAADGGCGEIVEVQGGHIVRSTGRKDRHSKVCTAKGPRDRRVRLSAHTAIQFYDVQDRLGFDRPSKAVDWLIKKAKTSIDELAELPPWNPADAIRLAAANAKPRRTTAKTQISPSPPPPQQQQQQQQLQFGVGFNGGGAEHPSNNESSFLPPSMDSDSIADTIKSFFPVIGSSTEAPSNHNLMHNYHHQHPPDLLSRTNSQNQDLRLSLQSFPDGPPSLLHHQHHHHTSASASEPTLFYGQSNPLGFDTSSWEQQSSEFGRIQRLVAWNSGGGGGATDTGNGGGFLFAPPTPSTTSFQPVLGQSQQLYSQRGPLQSSYSPMIRAWFDPHHHHQSISTDDLNHHHHLPPPVHQSAIPGIGFASGEFSSGFRIPARFQGQEEEQHDGLTHKPSSASSISRH

SEQ ID NO: 684 - protein, 181 aa, Arabidopsis thaliana
MEGQRTQRRGYLKDKATVSNLVEEEMENGMDGEEEDGGDEDKRKKVMERVRGPSTDRVPSRLCQVDRCTVNLTEAKQYYRRHRVCEVHAKASAATVAGVRQRFCQQCSRFHELPEFDEAKRSCRRRLAGHNERRRKISGDSFGEGSGRRGFSGQLIQTQERNRVDRKLPMTNSSFKRPQIR

SEQ ID NO: 685 - protein, 876 aa, Arabidopsis thaliana
MACRFPLHSSSPSQFLSPENRQRLPRNYPSISCQNNSATNVVHEDGDDNDKAKTNQVNLLAIPITLTIISASLAKPSFAAAKVTERKRTQKKPQEALTLEQLKAWSKDLPVVSNRIPYTDILSLKAEGKLKHVIKPPNLSLRQKAEPVLVVLEDSRVLRTVLPSLEGNKRFWEQWDELGIDVQCVNAYTPPVKRPPVPSPYLGFLWKVPAYMLTWVKPKKESKRAAELKRMREDFKRQRKEEIETMKEERVMMEKTMKAQKKQQERKKRKAVRKKKYEESLREARKNYRDMADMWARLAQDPNVATALGLVFFYIFYRVVVLNYRKQKKDYEDRLKIEKAEADERKKMRELEREMEGIEEEDEEVEEGTGEKNPYLQMAMQFMKSGARVRRASNKRLPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSLETWRQVAINEAAMAVVAVNFPDMKNIEFLTINPRAGRELGYVRVKMDHIKFKEGMLSRQSILDHITVQLAPRAADELWYGEDQLSTIWAETSDNARSAARSLVLGGLSDKHHGLNNFWVADRINDIDVEALRILNMCYERAKEILGRNRTLMDEVVEKLVQKKSLTKQEFFTLVELYGSSKPMPPSILELRKIKRLELEEMVLKLDMTTARNSS

SEQ ID NO: 686 - protein, 1429 aa, Arabidopsis thaliana
MAVSAGALAFPALSVRATLNPEIKDEQANISSTTSSSQKFTYSRASPAVRWPHLNLREIYDSTPSQTLSSPVSPIAGTPDSGDVVDSIASREEQKTKDETAVATRRRRVKKMNKVALIKAKDWRERVKFLTDKILSLKSNQFVADILDARLVQMTPTDYCFVVKSVGQESWQRALEVFEWLNLRHWHSPNARMVAAILGVLGRWNQESLAVEIFTRAEPTVGDRVQVYNAMMGVYSRSGKFSKAQELVDAMRQRGCVPDLISFNTLINARLKSGGLTPNLAVELLDMVRNSGLRPDAITYNTLLSACSRDSNLDGAVKVFEDMEAHRCQPDLWTYNAMISVYGRCGLAAEAERLFMELELKGFFPDAVTYNSLLYAFARERNTEKVKEVYQQMQKMGFGKDEMTYNTIIHMYGKQGQLDLALQLYKDMKGLSGRNPDAITYTVLIDSLGKANRTVEAAALMSEMLDVGIKPTLQTYSALICGYAKAGKREEAEDTFSCMLRSGTKPDNLAYSVMLDVLLRGNETRKAWGLYRDMISDGHTPSYTLYELMILGLMKENRSDDIQKTIRDMEELCGMNPLEISSVLVKGECFDLAARQLKVAITNGYELENDTLLSILGSYSSSGRHSEAFELLEFLKEHASGSKRLITEALIVLHCKVNNLSAALDEYFADPCVHGWCFGSSTMYETLLHCCVANEHYAEASQVFSDLRLSGCEASESVCKSMVVVYCKLGFPETAHQVVNQAETKGFHFACSPMYTDIIEAYGKQKLWQKAESVVGNLRQSGRTPDLKTWNSLMSAYAQCGCYERARAIFNTMMRDGPSPTVESINILLHALCVDGRLEELYVVVEELQDMGFKISKSSILLMLDAFARAGNIFEVKKIYSSMKAAGYLPTIRLYRMMIELLCKGKRVRDAEIMVSEMEEANFKVELAIWNSMLKMYTAIEDYKKTVQVYQRIKETGLEPDETTYNTLIIMYCRDRRPEEGYLLMQQMRNLGLDPKLDTYKSLISAFGKQKCLEQAEQLFEELLSKGLKLDRSFYHTMMKISRDSGSDSKAEKLLQMMKNAGIEPTLATMHLLMVSYSSSGNPQEAEKVLSNLKDTEVELTTLPYSSVIDAYLRSKDYNSGIERLLEMKKEGLEPDHRIWTCFVRAASFSKEKIEVMLLLKALEDIGFDLPIRLLAGRPELLVSEVDGWFEKLKSIEDNAALNFVNALLNLLWAFELRATASWVFQLGIKRGIFSLDVFRVADKDWGADFRRLSGGAALDASLEGYPESPKSVVLITGTAEYNGISLDKTLKACLWEMGSPFLPCKTRTGLLVAKAHSLRMWLKDSPFCFDLELKDSVSLPESNSMDLIDGCFIRRGLVPAFNHIKERLGGFVSPKKFSRLALLPDEMRERVIKTDIEGHRQKLEKMKKKKMGNETNGINTRRKFVRSK

SEQ ID NO: 687 - protein, 848 aa, Arabidopsis thaliana
MALAPLNFTEMPLRSSLPLTSSSRYCSSPSLHALLFYSLGVKPSRQQIVRPFSSLRTSERSNNRSNNNRRLDQRNHKPTPPWIDKWPPSSSGAGGDHAGKKGGENNGGDRIRSAEEEAEAKLRYLEKDKGQNAIERIVLRLRNLGLGSDDEDDVEDDEGGGINGGDVKPVTGEERLGDLLKREWVRPDMMLAEGEESEEEDEVLLPWEKNEEEQAAERVVGEGGVAVMQKRRARAPSLAELTVEDSELRRLRRDGMYLRVRINIPKAGLTQAVMEKIYDTWRKEELVRLKFHEVLARDMKTAHEIVERRTGGMVIWRAGSVMVVYRGLDYKGPPVISNQMAGPKETLFVPDVSSAGDEATNAKDNQSAPLVIKDPIIKNPIRKENMTEEEVEFNSLLDSLGPRFQEWWGTGVLPVDADLLPPTIPGYKTPFRLLPTGMRSNLTNAEMTNLRKIGKTLPCHFALGRNRNHQGLAAAILQIWEKSLIAKIAVKRGIQNTNNKLMADEVKTLTGGVLLLRNKYYIVIYRGKDFLPSSVAATLAERQELTKEIQDVEERVRNREIEAVQPVGDKVPAEAGTLAEFYEAQARWGKEITPDHREKMIEEASRVANARVVKRIQHKLNLAQSKFQRAEKLLSKIEASMIPNGPDYDQEVISEEERAMFRKVGLKMKAYLPIGIRGVFDGVIENMHLHWKHRELVKLISKQKNQAFVEETARLLEYESGGVLVAIEKVPKGFALIYYRGKNYRRPISLRPRNLLTKAKALKRSIAMQRHEALSQHISELERTIEQMQSQLTSKNPSYSESEWENDEDDDDDEEEEKDDVEDNESDWDETDGESAISSIEEADMSSR

SEQ ID NO: 688 - protein, 561 aa, Arabidopsis thaliana
MSDLQTPLVRPKRKKTWVDYFVKFRWIIVIFIVLPFSATFYFLIYLGDMWSESKSFEKRQKEHDENVKKVIKRLKGRDASKDGLVCTARKPWIAVGMRNVDYKRARHFEVDLGEFRNILEINKEKMTARVEPLVNMGQISRATVPMNLSLAVVAELDDLTVGGLINGYGIEGSSHIYGLFADTVEAYEIVLAGGELVRATRDNEYSDLYYAIPWSQGTLGLLVAAEIRLIKVKEYMRLTYIPVKGDLQALAQGYIDSFAPKDGDKSKIPDFVEGMVYNPTEGVMMVGTYASKEEAKKKGNKINNVGWWFKPWFYQHAQTALKKGQFVEYIPTREYYHRHTRCLYWEGKLILPFGDQFWFRYLLGWLMPPKVSLLKATQGEAIRNYYHDMHVIQDMLVPLYKVGDALEWVHREMEVYPIWLCPHKLFKQPIKGQIYPEPGFEYENRQGDTEDAQMYTDVGVYYAPGCVLRGEEFDGSEAVRRMEKWLIENHGFQPQYAVSELDEKSFWRMFNGELYEECRKKYRAIGTFMSVYYKSKKGRKTEKEVREAEQAHLETAYAEAD

SEQ ID NO: 689 - protein, 282 aa, Arabidopsis thaliana
MEALYAKLYDKYTKLQKKKYSEYDEINKEQEEKFLTFVSASEELMEHLRGENQSSLEMVEKLRNEIISIRSGRDDKFLECQKLLMEEELKNKSLSEEVVKLKELVQEEHPRNYEDQSGKKQKRKTPESARVTTRSMIKRSRLSEDLVETDMVSPDISKHHKAKEPLLVSQPQCCRTTYDGSSSSASCTFQALGKHLLGMKLSTNNKGKRACIVASHPTTGLSFSLTFINNPNGEESELLYKPASLGTFQRVAPEWMREVIKFSTSMCPIFFERVSRVIKLNC

SEQ ID NO: 690 - protein, 869 aa, Arabidopsis thaliana
MVSLSNQTRFSFHPNNLVVSEKRRLGISGVNFPRKIKLKITCFAAERPRQEKQKKKSQSQSTSDAEAGVDPVGFLTRLGIADRIFAQFLRERHKALKDLKDEIFKRHFDFRDFASGFELLGMHRHMEHRVDFMDWGPGSRYGAIIGDFNGWSPTENAAREGLFGHDDYGYWFIILEDKLREGEEPDELYFQQYNYVDDYDKGDSGVSAEEIFQKANDEYWEPGEDRFIKNRFEVPAKLYEQMFGPNSPQTLEELGDIPDAETRYKQWKEEHKDDPPSNLPPCDIIDKGQGKPYDIFNVVTSPEWTKKFYEKEPPIPYWLETRKGRKAWLQKYIPAVPHGSKYRLYFNTPDGPLERVPAWATYVQPEDEGKQAYAIHWEPSPEAAYKWKYSKPKVPESLRIYECHVGISGSEPKVSTFEEFTKKVTNFFAASSRYGTPDDFKRLVDEAHGLGLLVFLDIVHSYAAADQMVGLSLFDGSNDCYFHYGKRGHHKHWGTRMFKYGDLDVLHFLISNLNWWITEYQVDGYQFHSLASMIYTHNGFASFNNDLDDYCNQYVDRDALMYLILANEILHVQHPNIITIAEDATYYPGLCEPVSQGGLGFDYYVNLSASEMWVSLLDNVPDNEWSMSKIVSTLVANKEYADKMLSYAENHNQSISGGRSFAEILFGGVDNGSPGGKELLDRGISLHKMIRLITFTSGGRAYLNFMGNEFGHPERVEFPTQSNNFSFSLANRRWDLLESGVHHHLFSFDKELMDLDKSKGILSRGLPSIHHVNDANMVISFSRGPFLFIFNFHPSNSYEKYDVGVEEAGEYTMILNSDEVKYGGQGIVTEDHYLQRSISKRIDGQRNCLEVFLPSRTAQVYKLTRILRI

SEQ ID NO: 691 - protein, 670 aa, Arabidopsis thaliana
MAGDDLVETKKGSSKNSKDSNESKLKQKSPAEFFAENKNIAGFDNPGKSLYTTVRELVENALDSAESISELPEVEVTIEEIVKSKFNSMIGLIDRERVDTQLYDDYETEKARGKRLAKEARASEIQAKNLASGKKNKEPGVSKVLKARGEASYYKVTCKDNGKGMPHDDIPNMFGRVLSGTKYGLKQTRGKFGLGAKMALIWSKMSTGLPIEISSSMKSQNYVTFCRLDIDIHRNIPHIHLHEKKGNKEKWHGAEIQVVIEGNWTTYRSKILHYMRQMAVITPYAQFLFRFISETPEKNVTIKFTRRTDVMPPIPIETKHHPSSVDLLLIKRLITDTSKKTLLQFLQNEFVNINKTLAARLIGEMGPDFGPSMAVKSVTSQQMVRIHQLFRQAKFDDPSGDCLSPAGEYNLRLGIIKELHPDMVATYSGSAQVFEGHPFIVEAGVSLGGRDVKQGINIFRFANRIPLLFEQGADVVTRTALKRINWNSYKINQTQDKIGVFVSIVSTKIPFKGTGKEYIGDDISEIATAVKSAIQQCCIQLKSKIVKRLQAREQQERKRSLSRYIPDATGAVYEVLKQMTEEHKTKRKRYGEEDIVMLDKVSKQIITKETLKEKLAEHVEQVDYEMALEYATQSGVSEEPRENIYLQHLDPNKSNFIDLHSPTFVFRLML

SEQ ID NO: 692 - protein, 365 aa, Arabidopsis thaliana
MDESLEHQTQTHDQESEIVTEGSAVVHSEPSQEGNVPPKVDSEAEVLDEKVSKQIIKEGHGSKPSKYSTCFLHYRAWTKNSQHKFEDTWHEQQPIELVLGKEKKELAGLAIGVASMKSGERALVHVGWELAYGKEGNFSFPNVPPMADLLYEVEVIGFDETKEGKARSDMTVEERIGAADRRKMDGNSLFKEEKLEEAMQQYEMAIAYMGDDFMFQLYGKYQDMALAVKNPCHLNIAACLIKLKRYDEAIGHCNIVLTEEEKNPKALFRRGKAKAELGQMDSARDDFRKAQKYAPDDKAIRRELRALAEQEKALYQKQKEMYKGIFKGKDEGGAKSKSLFWLIVLWQWFVSLFSRIFRRHRVKAD

SEQ ID NO: 693 - protein, 504 aa, Arabidopsis thaliana
MVVINSLRRLARTTQVHLHSKYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 694 - protein, 695 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQIMKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 695 - protein, 344 aa, Arabidopsis thaliana
MMASLKAEETSQMQLVEREENDEDEDLFEMIDKLIAQGINAGDVKKLQEAGIHTCNGLMMHTKKNLTGIKGLSEAKVDKICEAAEKIVNFGYMTGSDALIKRKSVVKITTGCQALDDLLGGGIETSAITEAFGEFRSGKTQLAHTLCVTTQLPTNMKGGNGKVAYIDTEGTFRPDRIVPIAERFGMDPGAVLDNIIYARAYTYEHQYNLLLGLAAKMSEEPFRILIVDSIIALFRVDFTGRGELADRQQKLAQMLSRLIKIAEEFNVAVYMTNQVIADPGGGMFISDPKKPAGGHVLAHAATIRLLFRKGKGDTRVCKVYDAPNLAEAEASFQITQGGIADAKD

SEQ ID NO: 696 - protein, 462 aa, Arabidopsis thaliana
MQMTSWMQAELFILRLSRSSGVLGLAGTAFASEIFSRNLQLDAKHMKNQSIRLVRPLLDLWKEDMYKICQWGRQDWVEDPTNRSQLFVRNRIRTSIGNLESGSFKSELQAVISECRRTRSFVDKVCTDLIHQTVTVTDKGYAILDLERLNPSGVKDICLSKYLFAVLQFISQRQRPIRGNTSKLLLNYIRAIPCRTSLTAAGCYLSPAPGSKGTKIIVSCSVDCPLPSKTELLNISFNETPSDDLGQIIADAKSFSDHVAPTSLFEVQFLDVASESVLSKARELNLLSESTYTTIGLLQRDETKRFLTKTEEKSVELEHGTNIAASSDKVHLCLGQNLYFMNRFLIRWNLSDHQCNEADCRNCPVSTATSMEVRHMVEPDWLYLAELSKCSTSNHSISSSQKALRSLKLIPAAARKSLPVLVNHCGLLLCIPAIGFSYCSCLEASAVFLPRIPLGGGHSSFL

SEQ ID NO: 697 - protein, 159 aa, Arabidopsis thaliana
MSYNSYAEMSYLLKTLTTKEEIDRVIRDTIDEVLVLRFGRSSDAVCLQHDEILAKSVRDVSKFAKVALVDVDSEDVQVYVKYFDITLFPSTIFFFNAHHMKLDSGTADHTKWVGAFHIKQDFIDVVEAIYRGAMKGKMIVQCPIPPERIPKYQLVYKDV

SEQ ID NO: 698 - protein, 209 aa, Arabidopsis thaliana
MASKTAAAKDIITLHGSAAIVSEFFCYAANSILYNRAVYPEESFVKVKKYGLPMLLIEDESVKSFMSNLTSQISEWLEAGKLQRVVLVIMSKATGEVLERWNFRIETDNEVVDKGVSREKSDKEIMREIQAIMRQVASSVTYLPCLDETCVFDVLAYTDTDVAVPFTWIESDPKLIANPQMVKLHGFDTKIHKVDTLVSYKNDEWDEEE

SEQ ID NO: 699 - protein, 228 aa, Arabidopsis thaliana
MRIRRRDEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSPPSLFITAATPSSCHHQQENIYENIAKSFNGVVSASYEDKPKQELAQKDVLMATTNDPSHYYGNNALWVHDDDFELSSLVMMNFASGDVEYCL

SEQ ID NO: 700 - protein, 540 aa, Arabidopsis thaliana
MGAVWLSHVSQLVCGCYLIEQSSCVLRTFHWSLSHSLNFTLTMKPKRRRLGVKMESFSLATPNMCFRKVSSELDSSFNGENVVCGLELEEKTAGDRNRIHFLEERNEETLSKRLRKLSRLDKVRSALELFDSMRFLGLQPNAHACNSFLSCLLRNGDIQKAFTVFEFMRKKENVTGHTYSLMLKAVAEVKGCESALRMFRELEREPKRRSCFDVVLYNTAISLCGRINNVYETERIWRVMKGDGHIGTEITYSLLVSIFVRCGRSELALDVYDEMVNNKISLREDAMYAMISACTKEEKWDLALKIFQSMLKKGMKPNLVACNTLINSLGKAGKVGLVFKVYSVLKSLGHKPDEYTWNALLTALYKANRYEDVLQLFDMIRSENLCCLNEYLYNTAMVSCQKLGYWEKAVKLLYEMEGSGLTVSTSSYNLVISACEKSRKSKVALLVYEHMAQRDCKPNTFTYLSLVRSCIWGSLWDEVEDILKKVEPDVSLYNAAIHGMCLRREFKFAKELYVKMREMGLEPDGKTRAMMLQNLKKHQK

SEQ ID NO: 701 - protein, 421 aa, Arabidopsis thaliana
MSNIVVLDNGGGLIKAGQGGERDPTTVIPNCLYKPLSSKKFIHPSPLTTLSDEIDLTSAAVRRPIDRGYLINSDLQREIWSHLFTSLLHIAPSSSSLLLTEAPLSIPSVQRTTDELVFEDFGFSSLYIAHPQSLVHLYEASRQPDSILSKTQCSLVVDCGFSFTHAVPVLHNFTLNHAIKRIDLGGKAFTNYLKELVSYRSINVMDETFLVDDAKEKLCFVSLDLLRDLRLARNGNTLIKSTYVLPDGVTHTKGYVKDPQAAKRFLSLSEKESVVVMDKVGERKKADMNKNEIDLTNERFLVPETLFQPADLGMNQAGLAECIVRAINSCHSYLQPVLYQSIILTGGSTLFPQLKERLEGELRPLVPDHFDVKITTQEDPILGVWRGGSLLASSPDFESMCVTKAEYEELGSARCRRRFFH

SEQ ID NO: 702 - protein, 496 aa, Arabidopsis thaliana
MEFSCVHFLQNKTILVTGATGFLAKVFVEKILRVQPNVNKLYLVVRASDNEAATKRLRTEAFEKDLFKVLRDNLGDEKLNTLLSEKVVPVAGDIAMDHLGMKDSNLRERMQKEIDIVVNVAATTNFDERYDIGLGINTFGALNVLNFAKKCVKAQLLLHVSTAYVCGEKPGLLPEKPFVMEEICNENGLQLDINLERELMKQRLKELNEQGCSEEGTTFYMKELGMERAKLHGWPNTYVFTKSMGEMLLGNHKENLPLVIIRPTMITSTLFEPFPGWIEGLRTVDSVIIAYGKGVLKCFLVDVNSVCDMIPADMVANAMIAAAATHAGGSKVHMVYQVGSSHQNPIIYGEIREILFCYFTKNSLRSRNGSMITVSKMKLIPTLALFSLYMTIRYKLPVQLLKLVDIIYPSREGDEYKNKNRKIDMVMRLVKLYEPYVLFKGIFDDRNTKNLCAKQKEEDNRNSENFMFDFDPKIIKWKDYLINVHIPGLITHVLKK

SEQ ID NO: 703 - protein, 537 aa, Arabidopsis thaliana
MSVVLLSSTSATITKSQSKKIPFLSPTTKFPLKVSISPSRSKLFHNPLRVAAPPSVPTSDSTEEKRIEEEYGGDKEEEGSEFKWRDHWYPVSLVEDLDPNVPTPFQLLGRDLVLWFDRNDQKWAAFDDLCPHRLAPLSEGRLDENGHLQCSYHGWSFGGCGSCTRIPQAATSGPEARAVKSPRACAIKFPTMVSQGLLFVWPDENGWDRANSIEPPRLPDDFDKPEFSTVTIQRDLFYGYDTLMENVSDPSHIDFAHHKVTGRRDRAKPLPFKVESSGPWGFQGANDDSPRITAKFVAPCYSMNKIELDAKLPIVGNQKWVIWICSFNIPMAPGKTRSIVCSARNFFQFSVPGPAWWQVVPRWYEHWTSNLVYDGDMIVLQGQEKVFLAKSMESPDYDVNKQYTKLTFTPTQADRFVLAFRNWLRRHGKSQPEWFGSTPSNQPLPSTVLTKRQMLDRFDQHTQVCSSCKGAYNSFQILKKFLVGATVFWAATAGVPSDVQIRLVLAGLSLISAASAYALHEQEKNFVFRDYVHSEIE

SEQ ID NO: 704 - protein, 448 aa, Arabidopsis thaliana
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 705 - protein, 1067 aa, Arabidopsis thaliana
MAILHFSLPLIVSFLRPHASPRFFLLPRSLSQSPFLSRRRFHRTSAVSSAAVHHQSYRNPDDDVTRAVSVPTFQQAIQRLQEYWASVGCAVMQPSNTEVGAGTMNPCTFLRVLGPEPWNVAYVEPSIRPDDSRYGENPNRLQRHTQFQVILKPDPGNSQQLFINSLSALGIDVTAHDIRFVEDNWESPVLGAWGLGWEIWMDGMEITQFTYFQQAGSLPLSPVSVEITYGLERIIMLLQEVDHFKKILYADGITYGELFLENEKEMSSYYLEHASVDRLQKHFDYFDEEARSLLALGLPIPAYDQLLKTSHAFNILDARGFIGVTERARYFGRMRSLARQCAQLWLATRESLGHPLGVASEPVPPVCHRAALEKVAEKVSEDPRSFIIEIGTEEMPPQDVINASEQLRVLVLELLENQRLRHGAVKAFGTPRRLVVLVDAMSSKQLEEEVEVRGPPASKAFDDEGNPTKAAEGFSRRYGVPLEKLYRKVSGKTEYVHARVTEPARLALEVLSEDLPGILAKISFPKSMRWNSSVMFSRPIRWVMALHGDLVVPFSFAGISSGNVSCGLRNTASASLLVQNAESYEDTMRNSGINIEIEERKKIILEKSNALAKSVSGRLVVPQNLLNEVANLVEAPVPLIGKFKESFLELPEELLTIVMQKHQKYFSIIDESGQLLPYFIAVANGAINEDVVKKGNEAVLRARYEDAKFFYEVDTRKRFSEFRDQLQGILFHEKLGTMLDKMNRLKKMVSKLCLALKIDEDLLPVVEDAASLAMSDLATAVVTEFTALSGIMARHYALRDGYSEQIAEALLEITLPRFSGDVIPKTDAGMVLAIGDRLDSLVGLFAAGCQPSSTNDPFGLRRISYGLVQILVEKDKNVNFKRVLELAASVQPTKVEANTVEDVYQFVTRRLEQLLVDNGVSPEVVRSVLAERGNNPCLAARTAYKTEKLSKGEMFPKIVEAYSRPTRIVRGKDVGVGVEVDENAFETPQERTLWSTYTSIKDRIHTGIEIEDFTEISMQLVEPLEDFFNNVFVMVEEERVRKNRLALLNNIANLPKGVIDLSFLPGF

SEQ ID NO: 706 - protein, 3255 aa, Arabidopsis thaliana
MKLQNPDKKTLREGFSQESSVVALDSGVLAMSGLKCDGKFPVKDVLMEEGGDKVRKIQVSGGNISLVVDFSGARTSSNNFFESNASCVNENLVKGNGYREDETQEFLVGNLVWVMTKYKKWWPGEVVDFKADAKESFMVRSIGQSHLVSWFASSKLKPFKESFEQVLNQRNDNGFFDALQKAMSLLSNSLKLDMTCSCIADGNGIVSAQNITTRKNKPLILREFSVDRLEPKEFVTQLKNIAKCVLNAGVLESTVMQSQLSAFYTLFGHKQIPMAQLHENEGRKSFTAKMSDSKFIGSPSICAGNSRKRFRKEWFRKFVSEVDNVSARDDLVNVPPSDLISKLKLLAVGYNCSEETENIGLFEWFFSKFRISVYHDENAYKMQLANMAGFKDLMLATNANRGTVQKTLKSKKIGKSKMEPLNGVSVADTEQKTFELQISKKSNIESLNGVSVADTEQKTFELQILEKSNIESLNGVSTPNIDHEASKSNNSGKTKINHIIGHSNFPSSVAKVQLAKDFQDKLLVQAPDRKAMTADTLSRPAAILVPDLNSGGNALGTAEFDHMQRPETLIQHNVCPQEEKTPRSTILNFQVTAHQGVSGTQFVSSQPTSYKHFTSADLFTYSGKKKRGRKRKNAEELPIVAHASATTGIPDLNGTNTEPTLVLPQVEPTQRRRRRKKEESPNGLTRGITILFLKFSSQVSMPSRDDLTSTFSAFGPLDSSETHVSEEFSGAQVAFVSSADAIEAVKSLEKANPFGETLVNFRLQQKLITVQRNIAPRMPVISHVSPVPKPNNIPTSMDAMRQNLLMMTAMLEKSGDSLSRETKAKLKSEITGLLEKDGVKLLNTWLEGERSITFCRFLSQNTAKLKLDEIPNAETWPFLVKLLLQCVSMEVSGSKRRMPKPTFAKTLRVVVQRTEETKFPGVQFPLLSMAKTLFTHVHDILSNTPSFQSEYGTILRHLLEIKEYRFQMRKRTYSSLVLLYMERAETGFCEKNSGQHSQKEEAFRYILTLQSLLENSPGDFPDDLREEIVNGLIHIFSSVRDEGKLSRKLIECVNTFLLKDGPNLGSLSLEIHNAVEQFVFRCWLTTHDKNLKEILVSYGRLQLNLTRDSSESSSLVEQLLDVVTRELDLGSSSSSASWGDTTKDEKLGALSSYQNSLVELAAHVFYRACVNTSRPSLSEKRARRQHIAMRMVDALTEGKWLWCAAFGCLVRNYCARINMDLLIYWFEAICTNFQRLLEDASMRRSYDGLLWTLRSLQGLSSGLSLPDITMDISKSSASSSELDRGWQSIWSSLIHGLATFSSMSVIVDAVLVLLGSIISSNHITVKILPQEVWDHQLFRHIPSEPALYFIACYFSRMGCQGNLQDDLHLRRNLLRAVCAPLSWKVRLTLDERMVQLLPAAAFSLCAGFKVSLPLPKEHLPTPSQWDVCEQIDDVDRERNFGLFECSVEALTRICSNSSKISGCQVPDVVQLPLVLRDPLLHDMDIYFLSIIPEVKEKGPLSDIFMGCALLCHFMHGSYITRKGKGSSSFFLKACQYLLEGLDHAVESVSKSLNDLQRRGSLGFGSDFNEKGSIIVSLRSFTQSPVFSNRRDQNLLGASYDFVIHSLENLLRSFAKVYEEYTEHAWNTHSDTVPSKSLAPDSPEVGRIVDMDLDLAEDTKERDIIAAGGKAVPGLPVSMGNWKLGMVSLISCFSPVLQFPTWDVLYNLLEKESDPKVLENILYHLCKLSCLTSIPKVDDLVIFLDGMLSTQVKMKRNCLNIVTALHVLLHTLSSSRRDSSGVEKNCGLSLKEAESFQVFVQLGAMVNKVSEFGLLGWFGRVKLINCICDLVLLNPQTGQTMIERLLLMLSDSDYRVRFVLARQIGILFQTWDGHEALFQDICSSFGIKLVTSSKEKLVTAKDVLAVGPQPRQKMETVIITLMHLAYHSENIELQAVFMMCAVSAKDPCQRELIIAALDNLSAQLHYPSRFKYLEELLGPILFHWIASGVSLAGLIETSQLFIPNAEPKYFIHFCSHWLLPALLLHEDHTNLDWVAKMAGQPVVVLVKENFVPIFSICMGLHCSKTSECDKGAMVLQNSILYVGETSENERDKLIKQNMVSIVSFILSCASSSPEPPVPTFSRDTISLAVQTVVDGFLENTDYPKNAAITDRINIFRPDRVFMFITEMHYRMSAACHHRHTRHHLAALEELTILLGHRALVPSSLNYIFNLVGQFIGYPSLQDQCCSIASCLLDLFKSNPAKEIVSVLGDQLQFLVSKLVTCCIDAEADTKISGAKSSQLVNLLHKLVVSSDSSLNEDIRDLEPLPDLKYFQVIRESHIRICEAYSPRNHLLKVEHSTFLIYIFLEILSLSNFLFLSCSTIQQCSRRSNYLPPRFLSRSLQALHNKLIASEVSQEDTNGETAETFWQSDDEIVNAVWTLVRVSASDEADSMRLLVSDFLSRIGIRDPHTVVFHLPGNLVSMHGLQGFGHNTGSKVRSLTENGISDETLITLLNFLKKYLLDDSVKIIDVTSQTLRGILSTERGQQALSSFDSCERALIEVHGRGVNLDIVEKILLDSQKQFKAEKFSLETPEVWSTDNKNFDRWICQLVYCMIALCEDVPIRLCQNIALLKAEISELLFPSVVVSLAGRIGMDINLHDLITSQVKEHIFTDSNKLTKSKQVMLNTLNELRMCYVLERSIFSGQTKREKNSRSCSTAAKIRDVESGSNGMAASITTNWEKVYWLSIDYLVVAGSAVVCGAYLTASMYVEYWCEEKFGNLSLGDPDFSYHDKLPDHVEILVSAITRINEPDSLYGVIHSNKLSAQIITFEHEGNWTRALEYYDLQARSQKMVVPSSLSENLEVEQFQPTTSARHSVFGEGEVQRQPFKGLIRSLQQTGCMHVLDLYCRGLTSREGCFQYDPEFIELQYEAAWRAGKWDFSLLYPQTHCQPLQHAKNNNYHESLHCCLRALQEGDYDGFYGKLKDTKKELVLSISRASEESTEFIYSTVVKLQILHHLGLVWDLRWTTSSHQSVHGYLVKQMACVDPVIPTMDQLSWLNKDWNSIITQTQLHMTLLEPFIAFRRVLLQILGCEKCTMQHLLQSASLLRKGTRFSHAAASLHEFKFLCARSNGQQPVPDWLGKLEEAKLLHAQGRHEVSISLANYILHNYQLKEEASDIYRVIGKWLAETRSSNSRTILEKYLRPAVSLAEEQSSKICKRLVDRQSQTWFHLAHYADALFKSYEERLSSSEWQAALRLRKHKTKELEVLIKRFKSSKKATI

SEQ ID NO: 707 - protein, 1017 aa, Arabidopsis thaliana
MAEGTKQERTLENNLLHKVGEAVSAISDAKHVDQVISAIHSVAVLLFPVDPSLFSGNFEMLHIVRGSGTFGLLMILYLGSAQVCSSVVPSADERNEWLETFYRGVAFPTFARVLLLDVASDWLSCFPISVQKHLYDKFFLDGSVIEVVQVLVPFLHHVGDGGVNANSVQTNVERLLILCLLENDGVLKITKEIGNIYQGHNSSNGSLKPLLSRLSQILTSIPDKARASCTEANCTVIVLSFVGEVFSRICRRGLSDLLLSEVTPHVLAQVRRLLNSKIGAIEVDTFQLDPTTRIWSKTMEAVTDPYAVEKMAEQLLHQLYAEHPSDVEAFWTIWTLFHRNVIHQASVRQAKCFLWQLDSFFRYPFFFFHFHPNAVKQCVLECPPVTNTLAKGDVTQGLLETTQRLASVWSKREFLQSVQLEQQAYLQFLFPVTDISDITAALGLCLENMSREELDRTKDVMHSILQGVSCRLENPGDLVRKMASSIAFMFSKVIDPKNPLYLDDSITDNAIDWEFGLQTASITNTMENGDGENKRSASLTEVNESSRRNKQKENRKSKNISAFVLADPNEIVDLATLNCDTESDKDDGDDDASVSSDNSSVTSLEPYDLMDDDKDLGKQFTHLVDVVGALRKTDDADGVEKAIYVAEKLVRASPDELTHIAGDLARTLVQVRCSDIAIEGEEDSAEEKRQRALIALLVTRPFESLETLNNILYSPNVDVSQRIMILDVMAEAARELANSKTLKPKHEARGPLISNISDPQPWYLPSNASTPWKKVSETGSFHLNWANRFERELQSKPGQTKKGKSRRWSLKSADRDQNSTDWSQNRFPLYAAAFMLPAMKEFDKKRHGVDLLGRDFVVLGKLVHMLGVCMQCASMHPEASALAISLLDMLQRREVCNHPEAYVRRAVLFAASSVLVSLHPSYIVSTLVEGNLDLSRALEWIRTWALQIADSDIDRDCYTMALSCLQLHAEMALQTSRALESTGGSSSSSSIRPMNISLPSGISKLTSIKLPSSNVHL

SEQ ID NO: 708 - protein, 332 aa, Arabidopsis thaliana
MATDFKSLPVIDISRLLLKCDDPDMAEDVGVAEVVQQLDKACRDAGFFYVIGHGISEDVINKVREITREFFKLPYEEKLKIKMTPAAGYRGYQRIGENVTKGIPDIHEAIDCYREIKQGKYGDIGKVMEGPNQWPENPQEFKELMEEYIKLCTDLSRKILRGISLALAGSPYEFEGKMAGDPFWVMRLIGYPGAEFTNGQPENDIGCGAHTDYGLLTLVNQDDDKTALQVRNLGGEWISAIPIPGSFVCNIGDMLKILSNGVYESTLHRVINNSPQYRVCVAFFYETNFDAVVEPLDICKQKYPGGRGGCQVFKRAVYGEHLVSKVQTNFAM

SEQ ID NO: 709 - protein, 408 aa, Arabidopsis thaliana
MARVAFATSSPPLISSVRTLRRHFSVFAAANPEMSRPSHHSSLEVIGGGSDRFLPSLKDSLAKPYNAFPLIGFNRHVETIYASFFRSVPFVRLRRECLRTKDNGSVALDWVAGEDRHFPPDSPILILLPGLTGGSQDSYVRHMLLRAQSKKWRCVVFNSRGCGDSPVTTPQFYSASFLGDIGEVIDHVVDKFPKANLYAAGWSLGGNILVNYLGQESHNCPLTAAVSLCNPFDLVIADEDFHKGFNNVYDKALSKSLRRIFSKHSLLFEDIGGEFNIPLAANAETVRDFDDGLTRVSFGFKSVDEYYSKSSSSKAIKHVRIPLLCIQAANDPIAPERGIPRDDIKANPNCVLIVTPRGGHLGWVAGEEAPNGAPWTDQVVMEFLQHVENRETINGERSFEDVHDQIQV

SEQ ID NO: 710 - protein, 373 aa, Arabidopsis thaliana
MASENNGSRSDSESITAPKADSTVVEPRKIALITGITGQDGSYLTEFLLGKGYEVHGLIRRSSNFNTQRINHIYIDPHNVNKALMKLHYADLTDASSLRRWIDVIKPDEVYNLAAQSHVAVSFEIPDYTADVVATGALRLLEAVRSHTIDSGRTVKYYQAGSSEMFGSTPPPQSETTPFHPRSPYAASKCAAHWYTVNYREAYGLFACNGILFNHESPRRGENFVTRKITRALGRIKVGLQTKLFLGNLQASRDWGFAGDYVEAMWLMLQQEKPDDYVVATEEGHTVEEFLDVSFGYLGLNWKDYVEIDQRYFRPAEVDNLQGDASKAKEVLGWKPQVGFEKLVKMMVDEDLELAKREKVLVDAGYMDAKQQP

SEQ ID NO: 711 - protein, 541 aa, Arabidopsis thaliana
MDDCRFETSELQASVMISTPLFTDSWSSCNTANCNGSIKIHDIAGITYVAIPAVSMIQLGNLVGLPVTGDVLFPGLSSDEPLPMVDAAILKLFLQLKIKEGLELELLGKKLVVITGHSTGGALAAFTALWLLSQSSPPSFRVFCITFGSPLLGNQSLSTSISRSRLAHNFCHVVSIHDLVPRSSNEQFWPFGTYLFCSDKGGVCLDNAGSVRLMFNILNTTATQNTEEHQRYGHYVFTLSHMFLKSRSFLGGSIPDNSYQAGVALAVEALGFSNDDTSGVLVKECIETATRIVRAPILRSAELANELASVLPARLEIQWYKDRCDASEEQLGYYDFFKRYSLKRDFKVNMSRIRLAKFWDTVIKMVETNELPFDFHLGKKWIYASQFYQLLAEPLDIANFYKNRDIKTGGHYLEGNRPKRYEVIDKWQKGVKVPEECVRSRYASTTQDTCFWAKLEQAKEWLDEARKESSDPQRRSLLREKIVPFESYANTLVTKKEVSLDVKAKNSSYSVWEANLKEFKCKMGYENEIEMVVDESDAMET

SEQ ID NO: 712 - protein, 539 aa, Arabidopsis thaliana
MESSLFSPSSSSYSSLFTAKPTRLLSPKPKFTFSIRSSIEKPKPKLETNSSKSQSWVSPDWLTTLTRTLSSGKNDESGIPIANAKLDDVADLLGGALFLPLYKWMNEYGPIYRLAAGPRNFVIVSDPAIAKHVLRNYPKYAKGLVAEVSEFLFGSGFAIAEGPLWTARRRAVVPSLHRRYLSVIVERVFCKCAERLVEKLQPYAEDGSAVNMEAKFSQMTLDVIGLSLFNYNFDSLTTDSPVIEAVYTALKEAELRSTDLLPYWKIDALCKIVPRQVKAEKAVTLIRETVEDLIAKCKEIVEREGERINDEEYVNDADPSILRFLLASREEVSSVQLRDDLLSMLVAGHETTGSVLTWTLYLLSKNSSALRKAQEEVDRVLEGRNPAFEDIKELKYITRCINESMRLYPHPPVLIRRAQVPDILPGNYKVNTGQDIMISVYNIHRSSEVWEKAEEFLPERFDIDGAIPNETNTDFKFIPFSGGPRKCVGDQFALMEAIVALAVFLQRLNVELVPDQTISMTTGATIHTTNGLYMKVSQR

SEQ ID NO: 713 - protein, 273 aa, Arabidopsis thaliana
MLTPTISKSISLVTILLVLQAFSNTTKAQNCGCSSELCCSQFGFCGNTSDYCGVGCQQGPCFAPPPANGVSVAEIVTQEFFNGIISQAASSCAGNRFYSRGAFLEALDSYSRFGRVGSTDDSRREIAAFFAHVTHETGHFCYIEEIDGASKDYCDENATQYPCNPNKGYYGRGPIQLSWNFNYGPAGTAIGFDGLNAPETVATDPVISFKTALWYWTNRVQPVISQGFGATIRAINGALECDGANTATVQARVRYYTDYCRQLGVDPGNNLTC

SEQ ID NO: 714 - protein, 705 aa, Arabidopsis thaliana
MSQPLTTRPTVTGISIIPFRQPPPLCSFLFVIVLFVATFYTLHHPDAVTPPLLFSRNAYNALRLRRLFLSSASNATISSYLRELTRHPHLAGTKPSLDTLHYVFNHFQSLGLETHVAEYEALLSYPTHISVTASFSNTTTLEFDLNDVPGDSPVVRPYHAYSPSGSAQGNVVFVNHGEERDYHALESIGVSVKGCVVLARKGENLGRGAIVKIAEAKGALGVLIYAENDGGGFGGIERGTVMRGIGDPVSPGWPGVVGGEKLSLDDELVTRRFPKIPSLPLSLRNAEIILASLGGARAPLEWRNSGRVGPGQRVGPGRMVINMTFQGEMKMKKINNVVVTIRGSEEADRYVILGNHRDAWTYGAVDPNSGTSALLDISRRFALLLKSGWRPRRTILLCSWDAEEFGMIGSTEWIEENVLNLGASAVAYLNVDCAVQGSGFFAGATPQLDGLLVDVLKLVQDPDAVGLTVEETFKSQNNIIQRLSRVDSDFSGFLHHAGIPSIDMYYGADYPVYHTAFDSYDWMIHNADPLFHRHVAMAGIWGLLGILLADEPLIPFDYISYADQLQAHRDKLSKLLEGKVSVNPLSMAIQEFSLVAKEAADEAKKLKGKSYSKNDVAAAAKRRELNDRLMLVERGFLDAEGIKGKEWFKHLVYGPAAEPESKLGFFPGIADAIAMNASEGIIEHEIWRVARAIQRASKALKGGFT

SEQ ID NO: 715 - protein, 230 aa, Arabidopsis thaliana
MASLKLSPSSPISISKVGVIPSSKKGLSFLVKAEHHSSSSSSHLQDKCQRRLIVTFGVVAPWISLLSRAPLSFAAESKKGFLAVSDNKDAYAFLYPFGWQEVVIEGQDKVYKDVIEPLESVSVNLVPTSKQTIKEFGPPKQIAETLIKKVLAPPNQKTTLIDASEHDVDGKTYYQFEFTVQARNYTRHALGTITVFNGNFYTLTTGANERRWEKMKDRLHTVVDSFKITV

SEQ ID NO: 716 - protein, 241 aa, Arabidopsis thaliana
MEEGGSSHDAESSKKLGRGKIEIKRIENTTNRQVTFCKRRNGLLKKAYELSVLCDAEVALVIFSTRGRLYEYANNRYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 717 - protein, 265 aa, Arabidopsis thaliana
MATTNSLHHHHHSSPSYTHHRNNLHCQSHFGPTSLSLKQPTSAATFSLICSASSTSSSTTAVSAVSTTNASATTAETATIFDVLENHLVNQNFRQADEETRRLLIQISGEAAVKRGYVFFSEVKTISPEDLQAIDNLWIKHSDGRFGYSVQRKIWLKVKKDFTRFFVKVEWMKLLDTEVVQYNYRAFPDEFKWELNDETPLGHLPLTNALRGTQLLKCVLSHPAFATADDNSGETEDELNRGVAVAKEQAGVGADKRVFKTNYSF

SEQ ID NO: 718 - protein, 242 aa, Arabidopsis thaliana
MVTILSTPLSPRLTFLCETKLSLSRSNRSVCCSLSEEPKDQCLSRRSLVYVLVASPCLLLPALSSSAKTKSKSPYDERRLLEQNKRIQRENNAPDEFPNFVREGFEVKVLASDNYIKADSGLIYRDFNVGQGDFPKDGQQVTFHYIGYNESGRRIDSTYIQGSPARIRMGTNALVPGFEMGIRDMKPGGRRRIIIPPELGPPVGPSTFFSSKQFEVFDVELLSIQNCERRTIIGFYSDVTCS

SEQ ID NO: 719 - protein, 363 aa, Arabidopsis thaliana
MEALVVDAGSKFLKAGAAIPDQSPAMIIPSQMKRMVDDGSSSADNPTTVFEDVTLDPIERGLIRDWDAMEDLLRYVVYTGLGWEEGNEGNILFTDPLCTPKAIREQLVQLMFETFNVSGFYASEQAVLSLYAVGRISGCTVDIGHGKIDIAPVLEGAVQHIASKRFELGGTELTKLFAQELGKTNPSMNLSMSDVEKLKEQYANCAEDEIAYKKTQNCEIEQHTLPDGQVISIGRERYSVGEALFQPSILGLEEHGIVEQLVRIISTVSSENHRQLLENTVLCGGTTSMTGFESRFQKEANLCSSAIRPTLVKPPEYMPENLGMYSAWVGGAILAKVVFPQNQHVTKADYDETGPSVVHRKCF

SEQ ID NO: 720 - protein, 257 aa, Arabidopsis thaliana [sequence omitted]

SEQ ID NO: 721 - protein, 967 aa, Arabidopsis thaliana
MAETKAKRLLKVEIRFSFLVPIRFTNKRYQHRFNLPISKKIFGDSEMFCASSKIGLLGITRKQSFKVLVRIPFSLDSVGHVEKVEVNEDEILSRRRRSGLGDLELLVKIYLNYHEQREALFSGKAASVPPVKYEEQGIVVDEDEVLSRRRSGLDDLESVSSKLVYAKKLAEQMENGEYVTHKDTSLLKFVSSSSSSSEEEFRFVSSIQNAILRLDLIPKLPAIGRAVLVYRKSNEVECTELEKEMMRRKMKAWEERDMSEKGTVEVLHKEGLEKPLMSFEKPKFDRNELMSSISKVKGSEKKLELVNSSHVELDFDDKIHEIKVMARRAREIEAGIELNEKEKRDVNKETGDSDEDISIQSQKSLPHDGLTHSEGDDDKDERLGTSTDSENTELSAFAVPMLNGAMVDSGFPNHEMAASDKKKVSNVVPLVPTDGVIQASDVTKDQLSMMKNSTGRKSRVIRSVKEAKEFLSRRSGEKELTQELSQMAQDSDEIFPKQSDEERGVARKHKLDVDSQPQKNDYQKLSETGTAVKGSSSNKREELKSAKSSSGGTEHIEKEEPSGKENWIEKTTMNLSLETQEPGTIADIAELYRSEYNDELEWMKDEKLRDIVFCVRDNELADGVSVYDPLEKIIPRWKGPSLDKNPEFLNNYHEQREALFSGKAASVSPVKYEEQSSHQELSESASSENTLTPSSEITSSQPKIVVEGSDGSVRPGKKSGKEYWQHTKKWSRGFLELYNAETDPEVKAVMRDMGKDLDRWITEDEIKDAADIMEKLPERNKKFMEKKLNKLKREMELFVRAGTYARDADCLFLTEKSLLMLSVLFKVYGAMVDSGFPEHEIAASDKEKVSNLVPLVPTHGIIQSSEAEYCGICSNPIFTVYLDSVGNVAKVEVDEDEVLSRRSGLDDLELVSSRLQKVLEDQISGSDKLVQLQAKFKNALEEAVLAENGVENNCRDAEISCPDSSAP

SEQ ID NO: 722 - protein, 209 aa, Arabidopsis thaliana
MCDINWQVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 723 - protein, 135 aa, Arabidopsis thaliana
MAGAAAFVEADNAEEIMARIETKSQKIESLLKHYKHVEALKTALDGSPPKTLDERCKSANWIVVHRAIMAIKDIEGMLNSLTAEYYDILMKYLYRGLSTGDEPTCEQCLMIHEKLTERAGLGCILRCLSDTTNTV

SEQ ID NO: 724 - protein, 953 aa, Arabidopsis thaliana
MDAFKEEIEIGSSVESLMELLDSQKVLFHSQIDQLQDVVVAQCKLTGVNPLAQEMAAGALSIKIGKRPRDLLNPKAVKYLQAVFAIKDAISKRESREISALFGITVAQVREFFVTQKTRVRKQVRLSREKVVMSNTHALQDDGVPENNNATNHVEPVPLNSIHPEACSISWGEGETVALIPPEDIPPDISDSDKYFVENIFSLLRKEETFSGQVKLMEWIMQIQDASVLIWFLSKGGVLILTTWLSQAASEEQTSVLLLILKVLCHLPLHKASPENMSAILQSVNGLRFYRISDISNRAKGLLSRWTKLFAKIQAMKKQNRNSSQIDSQSQLLLKQSIAEIMGDSSNPEDILSLSNGKSENVRRIESSQGPKLLLTSADDSTKKHMLGSNPSYNKERRKVQMVEQPGQKAAGKSPQTVRIGTSGRSRPMSADDIQKAKMRALYMQSKNSKKDPLPSAIGDSKIVAPEKPLALHSAKDSPPIQNNEAKTEDTPVLSTVQPVNGFSTIQPVNGPSAVQPVNGPLAVQPVNGPSALQPVNGPSAVIVPVQADEIKKPSTPPKSISSKVGVMMKMSSQTILKNCKRKQIDWHVPPGMELDELWRVAAGGNSKEADVQRNRNRRERETTYQSLQTIPLNPKEPWDREMDYDDSLTPEIPSQQPPEESLTEPQDSLDERRIAAGAATTSSSLSSPEPDLELLAALLKNPDLVYALTSGKPSNLAGQDMVKLLDVIKTGAPNSSSSSNKQVEERVEVSLPSPTPSTNPGMSGWGQEGIRNPFSRQNQVGTAVARSGTQLRVGSMQWHQTNEQSIPRHAPSAYSNSITLAHTEREQQQYMQPKLHHNLHFQQQQQQPISTTSYAVREPVGQMGTGTSSSWRSQQSQNSYYSHQENEIASASQVTSYQGNSQYMSSNPGYESWSPDNSPSRNQLNMRGQQQQASRKHDSSTHPYWNQNKRWR

SEQ ID NO: 725 - protein, 208 aa, Arabidopsis thaliana
MATQAAGIFNSAITTAATSGVKKLHFFSTTHRPKSLSFTKTAIRAEKTDSSAAAAAAPATKEAPVGFTPPQLDPNTPSPIFAGSTGGLLRKAQVEEFYVITWNSPKEQIFEMPTGGAAIMREGPNLLKLARKEQCLALGTRLRSKYKITYQFYRVFPNGEVQYLHPKDGVYPEKANPGREGVGLNMRSIGKNVSPIEVKFTGKQSYDL

SEQ ID NO: 726 - protein, 302 aa, Arabidopsis thaliana
MEFHLEHPLSHSSLHNNFNDDTDYETLPHSLFLVEFQHMPSSHYFHSLKSSAFLLSNRNQAISSITQYSRKFDDPSLTYLAVNYLDRFLSSEDMPQSKPWILKLISLSCVSLSAKMRKPDMSVSDLPVEGEFFDAQMIERMENVILGALKWRMRSVTPFSFLAFFISLFELKEEDPLLLKHSLKSQTSDLTFSLQHDISFLEFKPSVIAGAALLFASFELCPLQFPCFSNRINQCTYVNKDELMECYKAIQERDIIVGENEGSTETAVNVLDQQFSSCESDKSITITASSSPKRRKTSTRRY

SEQ ID NO: 727 - protein, 210 aa, Arabidopsis thaliana
MAMSSGLFVKPTKMNHQMVRKEKIGLRISCQASSIPADRVPDMEKRKTLNLLLLGALSLPTGYMLVPYATFFVPPGTGGGGGGTPAKDALGNDVVAAEWLKTHGPGDRTLTQGLKGDPTYLVVENDKTLATYGINAVCTHLGCVVPWNKAENKFLCPCHGSQYNAQGRVVRGPAPLSLALAHADIDEAGKVLFVPWVETDFRTGDAPWWS

SEQ ID NO: 728 - protein, 973 aa, Arabidopsis thaliana
MSSHHQILQIRSDPFVLSHCCRHTRLTSSLTLQSPLKQPFSCLPFRWRRSYRGGVRSSTTETHGSKKEALVSETATTSIELKRVYPFHEIEPKWQRYWEDNRIFRTPDDVDTSKPKFYVLDMFPYPSGAGLHVGHPLGYTATDILARLRRMQGYNVLHPMGWDAFGLPAEQYAIETGTHPKTTTLKNIDRFRLQLKSLGFSYDWDRELSTTEPDYYKWTQWIFLQLYKKGLAYQAEVPVNWCPALGTVLANEEVVDGVSERGGHPVIRKPMRQWMLKITAYADRLLEDLDELEWPESIKEMQRNWIGRSEGAELNFSILDGEGRETDKEITVYTTRPDTLFGATYMVVAPEHQLLSYFVTAEQKQQVEEYKDFASRKSDLERTELQKDKTGVFTGCYAKNPANGDAIPIWVADYVLASYGTGAIMAVPAHDTRDNEFALKYNIPIKWVVRNEANSSDDAKQVYPGLGIIENSSTLETGLDINQLSSKEAALKVIEWAERTGNGKKKVNYKLRDWLFARQRYWGEPIPILILDESGETIAISESELPLTLPELNDFTPTGTGEPPLSKAVSWVNTVDPSTGKPAKRETSTMPQWAGSCWYYLRFMDPKNPEALVDKEKEKYWSPVDVYVGGAEHAVLHLLYSRFWHKVLYDIGVVSTKEPFKCVINQGIILGEVQYTAWKDQEGNYVSADTEERLNEHQQVTIPEEKVIKSGDHFVLKEDPSIRLIPRVYKMSKSRGNVVNPDDVVLEYGADSLRLYEMFMGPFRDSKTWNTSGIEGVHRFLARTWRLVIGLPQSDGSFKDGTLVTDDEPTLEQLRTLHKCIAKVTEEIESTRFNTGISGMMEFVNAAYKWNNQPRGIIEPFVLLLSPYAPHMAEELWSRLGHPNSLAYESFPKANPDYLKNTTIVLPVQINGKTRGTIEVEEGCSEDDAFVLASQDDKLRKYLDGQSIKKRIYVPGKILNVILDRTNVKVTTK

SEQ ID NO: 729 - protein, 156 aa, Arabidopsis thaliana
MAMKMKGIYKSFKSIMFVGKERDLEIGHPTEVKHVAHIGWGSSGSDPGWMSDFKAGAEFLSPRTSSFSHTRHSDSFFTTSDSTEFDQDQLNISDRIRDVPPIPVGLSKIHTKSKNRRKKPSSTSSPRSRPSPKSSRSMGLSKSSHKSMVSRLNSNA

SEQ ID NO: 730 - protein, 543 aa, Arabidopsis thaliana
MFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNVMRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 731 - protein, 341 aa, Arabidopsis thaliana
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 732 - protein, 111 aa, Arabidopsis thaliana
MAPRTPLALFVSLNLLFFTYTSATTGTCPKNSIEIGTCVTVLNLVDLTLGNPPVKPCCSLIQGLADLEAAVCLCTAVKASILGIVNINLPINLSVLLNVCSRNAPKSFQCA

SEQ ID NO: 733 - protein, 394 aa, Arabidopsis thaliana
MDSSYLRISLSFLFWALLLSPAVSQSSSCSSQTFSGVKSYPHCLDLPDLKAILHYSYDASNTTLAVVFSAPPSKPGGWIAWAINPKSTGMAGSQALVASKDPSTGVASVTTLNIVSYSSLVPSKLSFDVWDVKAEEAANDGGALRIFAKVKVPADLAASGKVNQVWQVGPGVSNGRIQAHDFSGPNLNSVGSLDLTGTTPGVPVSGGGGAGNSRIHKRNIHGILNAVSWGLLFPIGAMIARYMRIFESADPAWFYLHVSCQFSAYVIGVAGWATGLKLGSESKGIQYNTHRNIGICLFSIATLQMFAMLLRPRKDHKFRFVWNIYHHGVGYSILILGIINVFKGLSILNPKHTYKTAYIAVIGTLGGITLLLEVVTWVIVLKRKSAKSTKPLKA

SEQ ID NO: 734 - protein, 109 aa, Arabidopsis thaliana; identical to SEQ ID NO: 75

SEQ ID NO: 735 - protein, 768 aa, Arabidopsis thaliana
MRQRISFIRNMQNLWVFTTSIKNSRRSKKTKDFIDAKFACSRYGVTPESESSGSSSRRSTVKKTDCKASMHVKRRPDGKWIIHEFVKDHNHELLPALAYHFRIQRNVKLAEKNNIDILHAVSERTKKMYVEMSRQSGGYKNIGSLLQTDVSSQVDKGRYLALEEGDSQVLLEYFKRIKKENPKFFYAIDLNEDQRLRNLFWADAKSRDDYLSFNDVVSFDTTYVKFNDKLPLALFIGVNHHSQPMLLGCALVADESMETFVWLIKTWLRAMGGRAPKVILTDQDKFLMSAVSELLPNTRHCFALWHVLEKIPEYFSHVMKRHENFLLKFNKCIFRSWTDDEFDMRWWKMVSQFGLENDEWLLWLHEHRQKWVPTFMSDVFLAGMSTSQRSESVNSFFDKYIHKKITLKEFLRQYGVILQNRYEEESVADFDTCHKQPALKSPSPWEKQMATTYTHTIFKKFQVEVLGVVACHPRKEKEDENMATFRVQDCEKDDDFLVTWSKTKSELCCFCRMFEYKGFLCRHALMILQMCGFASIPPQYILKRWTKDAKSGVLAGEGADQIQTRVQRYNDLCSRATELSEEGCVSEENYNIALRTLVETLKNCVDMNNARNNITESNSQLNNGTHEEENQVMAGVKATKKKTVYRKRKGQQEASQMLESQQSLQPMETISSEAMDMNGYYGPQQNVQGLLNLMEPPHEGYYVDQRTIQGLGQLNSIAPAQDSFFTNQQAMSGMVGQIDFRPPPNFTYTLQEEHLSSAQLPGSSSRQL

SEQ ID NO: 736 - protein, 205 aa, Arabidopsis thaliana
MMMGLLMSGLIVSQANLPTAFASTPVFREYIDTFDGYSFKYPQNWIQVRGAGADIFFRDPVVLDENLSVEFSSPSSSNYTSLEDLGSPEEVGKRVLRQYLTEFMSTRLGVKRQANILSTSSRVADDGKLYYQVEVNIKSYANNNELAVMPQDRVARLEWNRRYLAVLGVENDRLYSIRLQTPEKVFLEEEKDLRRVMDSFRVEKI

SEQ ID NO: 737 - protein, 717 aa, Arabidopsis thaliana
MASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 738 - protein, 644 aa, Arabidopsis thaliana
MVNPGHGRGPDSGTAAGGSNSDPFPANLRVLVVDDDPTCLMILERMLMTCLYREQRAHCLCFGRTKNGFDIVISDVHMPDMDGFKLLEHVGLEMDLPVINLNVLKPLVIVMSADDSKSVVLKGVTHGAVDYLIKPVRIEALKNIWQHVVRKKRNEWNVSEHSGGSIEDTGGDRDRQQQHREDADNNSSSVNEGNGRSSRKRKEEEVDDQGDDKEDSSSLKKPRVVWSVELHQQFVAAVNQLGVDSELKTCLLMHLCVSIGNIVEFQKYRIYLRRLGGVSQHQGNMNHSFMTGQDQSFGPLSSLNGFDLQSLAVTGQLPPQSLAQLQAAGLGRPTLAKPGMSVSPLVDQRSIFNFENPKIRFGDGHGQTMNNGNLLHGVPTGSHMRLRPGQNVQSSGMMLPVADQLPRGGPSMLPSLGQQPILSSSVSRRSDLTGALAVRNSIPETNSRVLPTTHSVFNNFPADLPRSSFPLASAPGISVPVSVSYQEEVNSSDAKGGSSAATAGFGNPSYDIFNDFPQHQQHNKNISNKLNDWDLRNMGLVFSSNQDAATATATAAFSTSEAYSSSSTQRKRRETDATVVGEHGQNLQSPSRNLYHLNHVFMDGGSVRVKSERVAETVTCPPANTLFHEQYNQEDLMSAFLKQV

SEQ ID NO: 739 - protein, 1164 aa, Arabidopsis thaliana; identical to SEQ ID NO: 225

SEQ ID NO: 740 - protein, 505 aa, Arabidopsis thaliana
MRDEYRQSRGCGFVKYSSKETAMAAIDGLNGTYTMRGCNQPLIVRFAEPKRPKPGESREMAPPVGLGSGPRFQASGPRPTSNFGDSSGDVSHTNPWRPATSRNVGPPSNTGIRGAGSDFSPKPGQATLPSNQGGPLGGYGVPPLNPLPVPGVSSSATLQQQNRAAGQHITPLKKPLHSPQGLPLPLRPQTNFPGAQAPLQNPYAYSSQLPTSQLPPQQNISRATAPQTPLNINLRPTTVSSATVQFPPRSQQQPLQKMQHPPSELAQLLSQQTQSLQATFQSSQQAISQLQQQVQSMQQPNQNLPLSQNGRAGKQQWAGSAIPRVASTTGSTPVSYVQTAAPAVSQSVGSVKCTWTEHTSPDGFKYYYNGLTGESKWEKPEEMIVFEREQQKQQQHQEKPTIQQSQTQLQPLQQQPQQVQQQYQGQQLQQPFYSSLYPTPGASHNTQYPSLPVGQNSQFPMSGIGQNAQDYARTHIPVGAASMNDISRTQQSRQSPQELMWKNKA

SEQ ID NO: 741 - protein, 179 aa, Arabidopsis thaliana
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 742 - protein, 424 aa, Arabidopsis thaliana
MASLLGTSSSAIWASPSLSSPSSKPSSSPICFRPGKLFGSKLNAGIQIRPKKNRSRYHVSVMNVATEINSTEQVVGKFDSKKSARPVYPFAAIVGQDEMKLCLLLNVIDPKIGGVMIMGDRGTGKSTTVRSLVDLLPEINVVAGDPYNSDPIDPEFMGVEVRERVEKGEQVPVIATKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDADLRVKIVEERARFDSNPKDFRDTYKTEQDKLQDQISTARANLSSVQIDRELKVKISRVCSELNVDGLRGDIVTNRAAKALAALKGKDRVTPDDVATVIPNCLRHRLRKDPLESIDSGVLVSEKFAEIFS

SEQ ID NO: 743 - protein, 252 aa, Arabidopsis thaliana
TAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 744 - protein, 180 aa, Arabidopsis thaliana
MEKPGHETDIAGSRRTHLKKSFKSTLRHLLTACSKQDFVDIFSKFSGAEQELLFQLYTRVVVNLHQTIEEEFDEQCHETQVGPILDTVEELVEEQSLDPLFSDKTDVMAIAYDLTTSKKNEIQKLTVLLQRAEEQNRQKEARISMLKKQTQDLSGTADRIEKLNAGVSGYFEGKDKLPPI

SEQ ID NO: 745 - protein, 460 aa, Arabidopsis thaliana
MDEALNENASGSESDASSVASNLHDDEIIPWFFSREEIERNSPSRRDGIDLKTETRLRDSYCTFLEILGERLKVPQVTIATAIFFCHRFFLRQSHAKNDRQTIATVCMLLAGKVEETPVTLEDVIIASYERIHKKDLAGAQRKEVYDQQKELVLIGEELVLSTLNFDLCISHPYKPLVEAIKKYMVEDAKTQLAQFAWNFVNDCLRTTLCLQYQPHHIAAGAILLAAELPTVDLQSYREVLCQEFDITPCQLEDIRGQILELYERIPTSQESKVESSGGVAVVHQPISRDMASTEKCPSSDIEGGSSQVNLSQSDDHSVHDGSRSEGIGEVNSESEAQKNLQDHSVGNIMVEKSDDVGVVQLKKDLQLHQEEVESKQEKDKKSFEKDITKIDLMDEKDLTESEVEDEINKTMQTGRQIFMKVEDPDDNMTVEHSEIRNANNSGVDDELVADTCLINDSDL

SEQ ID NO: 746 - protein, 481 aa, Arabidopsis thaliana
MELRKSQVAMPVFLAIMSLMVSQVVFAEKDSGSMSPHDRALAEMQALKASLVRRNLPALVSPPPTPPQAVPGPRVYQVISYGADPTGKLDSTDAILKAMEEAFDGPNHGVLMQGINDLGGARIDLQGGSYLISRPLRFPSAGAGNLLISGGTLRASNDFPVDRYLIELKDESSKLQYIFEYITLRDLLIDCNYRGGAIAVINSLRTSIDNCYITRFGDTNGILVKSGHETYIRNSFLGQHITAGGDRGERSFSGTAINLMGNDNAVTDTVIFSARIGVMVSGQANLLSGVHCYNKATGFGGTGIYLRLPGLTQNRIVNSYLDYTGIVAEDPVQLQISGTFFLGDAFILLKSIAGYIRGVSIVDNMFSGSGHGVQIVQLDQRNTAFDDVGQVVVDRNSVNGMVEKSTVARGSVDGNGTSWTVDFNPVLLFPDLINHVQYTLVASEAGVFPLHALRNVSDNRVVVETNAPVTGTVYVTVNQGV

SEQ ID NO: 747 - protein, 1134 aa, Arabidopsis thaliana
MEKVSAACAMEWSIKLEKSLRSKNSVKAVEAILETGGKLEQWSKEPESAIAVYNLFGLVPEEDKLFSNTILLRLVDAFCVGDKLIKLAVVRVFMSMFKLSRGKNVNESASWFLSKGRVHNHLELLTRVKNVYDKGDTESKALALILFGCWRDFASEFAPVRYLVFSSMVSPHDLEGRSALFAAACFCEVADDFALVVLGMLNDMVKFPDITPKTRLAAVRVFAKMGCSHTIANRAFKICMKLMLDSPKEDNLVPFLVSLTKLASRSTHLASELAEVIIPFLGEDKTSHARAAVLRCLHFLIERGMCFSLAHERDIASVSSLLKQEELSSDMQVKALQIFQKIVVYKLCMTDASELLQLIAITENASHSQIFSSSCLAISVLVSIWTEIVRTAEKRSIEISSTSLPMQLVVLIMDRVALLGRLCSDLFRAGYAVVSEVQDLLKVLHLLVGKHSELRLLVLEKVRLFLTYIVSLNDGLRKADGAHELLFGVINYKDKRGVVMRSEFLASIHKFLIVFLENLEGDDNLLSEIYEKVKHITEFVSSCSFIDFHTQMIFTLLLHSPILWGFSVNDDTGNSGVSLVADIVNYGIVSLDCSNQILMERNYWPAYRAGVYAARLGAWVTSAMIFDQLKTNVQSDINCCWLKSLTYLSHAEGKFQLLLTPSDSVKLVNWLKNNGYLPELSKDASGEFAHCLALREAYMNLQSSLGMLGNIIASSGVFCFQTWFLVLKTRVLETVLELVECLGLLNQDLRNKNQVEEILLTGCDSLQQLPRISIQLQKLAKEFDMLATCFIDIDDSSSSIITTISLSCSVLAFAAGIVLFLPGFSFQEALVPFTSQSGLCSRLVEDLVRRLWKVDPNVCEKLNILVNTNESLNCFHLQSRNQVLRVCGKVKMLLSICRDALSCTYGLQNQSMSMHKEEIMSEITKSCRHLLSQAIMKWMQIPFGIPKYFFNIRPCVGAELFALSSESSKRIPDTVSVEQGFQLSLDLCLQLKNIKQRQVPVRLNKLYCLLYTKLAYHSPTQHGENNRNQMSYSPWRDEDLIEMSNKLFHHAIKSGKKPDVSGRFDWAKSGVSTVVQFEPNERGQGFSSCLLDVSRFPVGSYQIKWLSCCVDQHGSYWNLLPLNGKPVFTVKKAS

SEQ ID NO: 748 - protein, 942 aa, Arabidopsis thaliana
MAGGGKHTPTPKAIIHQKFGAKASYTVEEVHDSSQSGCLGLAIPQKGPCLYRCHLQLPEFSVVSNVFKKKKDSEQSAAELALDKLGIRPQNDDLTVDEARDEIVGRIKYIFSDEFLSAEHPLGAHLRAALRRDGERCGSVPVSVIATVDAKINSRCKIINPSVESDPFLAISYVMKAAAKLADYIVASPHGLRRKNAYPSEIVEALATHVSDSLHSREVAAVYIPCIDEEVVELDTLYISSNRHYLDSIAERLGLKDGNQVMISRMFGKASCGSECRLYSEIPKKYLDNSSDASGTSNEDSSHIVKSRNARASYICGQDIHGDAILASVGYRWKSDDLDYDDVTVNSFYRICCGMSPNGIYKISRQAVIAAQLPFAFTTKSNWRGPLPREILGLFCHQHRLAEPILSSSTAPVKSLSDIFRSHKKLKVSGVDDANENLSRQKEDTPGLGHGFRCEVKIFTKSQDLVLECSPRKFYEKENDAIQNASLKALLWFSKFFADLDVDGEQSCDTDDDQDTKSSSPNVFAAPPILQKEHSSESKNTNVLSAEKRVQSITNGSVVSICYSLSLAVDPEYSSDGESPREDNESNEEMESEYSANCESSVELIESNEEIEFEVGTGSMNPHIESEVTQMTVGEYASFRMTPPDAAEALILAVGSDTVRIRSLLSERPCLNYNILLLGVKGPSEERMEAAFFKPPLSKQRVEYALKHIRESSASTLVDFGCGSGSLLDSLLDYPTSLQTIIGVDISPKGLARAAKMLHVKLNKEACNVKSATLYDGSILEFDSRLHDVDIGTCLEVIEHMEEDQACEFGEKVLSLFHPKLLIVSTPNYEFNTILQRSTPETQEENNSEPQLPKFRNHDHKFEWTREQFNQWASKLGKRHNYSVEFSGVGGSGEVEPGFASQIAIFRREASSVENVAESSMQPYKVIWEWKKEDVEKKKTDL

SEQ ID NO: 749 - protein, 793 aa, Arabidopsis thaliana
MASRNQNRPPRSPNAKKEGLGGISFDKRRKVETQGGTGRRQAFSAVNKQDVTMNSDVGSIEECGKVDFTKDEILALLSERAKAGKFDTKAKIEQMTDIIKRLKVCVKWFQQADETHVQEKENLKVSLESSEQKYNHKELEARTKEEELQATISKLEENVVSLHEKLAKEESSTQDAIECHRREKEARVAAEKVQASLGEELDKVKEEKMAAKQKVTSLEDMYKRLQEYNTSLQQYNSKLQTDLETVRAALTRAEKEKSSILENLSTLRGHSKSLQDQLSSSRVLQDDAIKQKDSLLSEVTNLRNELQQVRDDRDRQVVQSQKLSEEIRKYQENVGKSSQELDILTAKSGSLEETCSLQKERLNMLEQQLAIANERQKMADASVSLTRTEFEEQKHLLCELQDRLADMEHQLCEGELLRKKLHNTILELKGNIRVFCRVRPLLPDDGGRHEATVIAYPTSTEAQGRGVDLVQSGNKHPFTFDKVFNHEASQEEVFFEISQLVQSALDGYKVCIFAYGQTGSGKTYTMMGRPEAPDQKGLIPRSLEQIFQASQSLGAQGWKYKMQVSMLEIYNETIRDLLSTNRTTSMDLVRADSGTSGKQYTITHDVNGHTHVSDLTIFDVCSVGKISSLLQQAAQSRSVGKTQMNEQSSRSHFVFTMRISGVNESTEQQVQGVLNLIDLAGSERLSKSGATGDRLKETQAINKSLSALSDVIFALAKKEDHVPFRNSKLTYLLQPCLGGDSKTLMFVNISPDPTSAGESLCSLRFAARVNACEIGIPRRQTSTKLLDSRLSYG

SEQ ID NO: 750 - protein, 493 aa, Arabidopsis thaliana
MRMLLGIPYVDKSVLSNSVLERGKQDKSKLLLVDKCHYELDVEERKEDFVGGFGFGVVENSHKDVMVLPHHHYYPSYSSPSSSSLCYCSAGVSDPMFSVSSNQAYTSSHSGMFTPAGSGSAAVTVADPFFSLSSSGEMRRSMNEDAGAAFSEAQWHELERQRNIYKYMMASVPVPPELLTPFPKNHQSNTNPDVDTYRSGMFSIYADYKNLPLSMWMTVTVAVATGGSLQLGIASSASNNTADLEPWRCKRTDGKKWRCSRNVIPDQKYCERHTHKSRPRSRKHVESSHQSSHHNDIRTAKNDTSQLVRTYPQFYGQPISQIPVLSTLPSASSPYDHHRGLRWFTKEDDAIGTLNPETQEAVQLKVGSSRELKRGFDYDLNFRQKEPIVDQSFGALQGLLSLNQTPQHNQETRQFVVEGKQDEAMGSSLTLSMAGGGMEETEGTNQHQWVSHEGPSWLYSTTPGGPLAEALCLGVSNNPSSSTTTSSCSRSSS

SEQ ID NO: 751 - protein, 245 aa, Arabidopsis thaliana
MVSLTDPERRRKLQAEEVGGGDKEVVREYFNSTGFERWRKIYGETDEVNRVQKDIRLGHAKTVENTMLMLTEDRSLAGVTVCDAGCGTGLLSIPLAKEGAIVSASDISAAMVAEAEMKAKAQLPSENLPKFEVNDLESLTGKYDTVVCLDVLIHYPQNKADGMIAHLASLAEKRVILSFAPKTFYYDILKRIGELFPGPSKATRAYLHSEADVERALGKVGWKISKRGLTTTQFYFSRLIEAVPM

SEQ ID NO: 752 - protein, 224 aa, Arabidopsis thaliana
MAAGLSTAVTFKPLHRSFSSSSTDFRLRLPKSLSGFSPSLRFKRFSVCYVVEERRQNSPIENDERPESTSSTNAIDAEYLALRLAEKLERKKSERSTYLIAAMLSSFGITSMAVMAVYYRFSWQMEGGEISMLEMFGTFALSVGAAVGMEFWARWAHRALWHASLWNMHESHHKPREGPFELNDVFAIVNAGPAIGLLSYGFFNKGLVPGLCFGAVSPSFIWSY

SEQ ID NO: 753 - protein, 371 aa, Arabidopsis thaliana
MAAAMSSSCCASSLRLIPFKRTLFSSIHYPAKTLLLRPLKPSEVPSFRRTIITFQKISTGIVPPPSASSSPSSYGDLQPIEELPPKLQEIVKLFQSVQEPKAKYEQLMFYGKNLTPLDSQFKTRENKVEGCVSQVWVRAFFDEERNVVYEADSDSVLTKGLAALLVKGLSGRPVPEILRITPDFAVLLGLQQSLSPSRNNGLLNMLKLMQKKALHLEVKGEEDSSSGESSESSFVSIPETKDEANVPEVDLESKPDLVEDLGTEKIDDSESGSNVVALGSRGMRIREKLEKELDPVELEVEDVSYQHAGHAAVRGSAGDDGETHFNLRIVSDAFQGKSLVKRHRLIYDLLQDELKSGLHALSIVAKTPAEV

SEQ ID NO: 754 - protein, 224 aa, Arabidopsis thaliana
MASLTSIATPYPSSSQALRLKSSGNTLFSAGVRSAAMVSGHKTLKIQCTSTKPAKPAAEVDWRQKRELLLEKRVRSVDVKEAQRLQKENNFVILDVRPEAEYKAGHPPGAINVEMYRLIREWTAWDIARRLGFAFFGIFSGTEENPEFIQSVEAKLDKEAKIIVACSSAGTMKPTQNLPEGQQSRSLIAAYLLVLNGYKNVFHLEGGIYTWGKEGLPVETIEED

SEQ ID NO: 755 - protein, 237 aa, Arabidopsis thaliana
MANNEGEMQCGSMLFKQEELQEMSGVNVGGDYVEVMCGCTSHRYGDAVARLRVFPTGDLEITCECTPGCDEDKLTPAAFEKHSGRETARKWKNNVWVIIGGEKVPLSKTVLLKYYNESSKKCSRSNRSQGAKVCHRDEFVGCNDCGKERRFRLRSRDECRLHHNAMGDPNWKCSDFPYDKITCEEEEERGSRKVYRGCTRSPSCKGCTSCVCFGCELCRFSECTCQTCVDFTSNVKA

SEQ ID NO: 756 - protein, 348 aa, Arabidopsis thaliana
MTLLALSSSLSSPSFFCRNSRIRFSPVSRISSLNGDNKLTNSPPQFLNAGASLRRFVAPGKFPSVRLRVLTRCEKENAPKGGIEDDAERFARRESTMPDRFRYLTKEAPDSPIIWPWFVALGFLVYAWRAVLFELSNWRKAAFAILAFVGDLSKFALALVFHFIGDPITSLISLVETAMYSVRAFYSGIVAYTPVRELTTVILLASSVLAIGEAVAPESISKQPYVVTIAGLVGYAAVQSYISEPFFWTVLLGLYGYSRLIKKRDDVTSALPSAAVLAGVGEPWVRVVAITGYLALAMYHNSTKTSSEEESQILRRAPPMPLLAAALAIGVRLAAKWAGYRHLTWMIV

SEQ ID NO: 757 - protein, 183 aa, Arabidopsis thaliana
MACVRSIGSLTSVNHSQRNVPRSGIVLSSCSVLPIKSSSFTGSPVSLPRAQPSSRTALRPMKPVSITMMVKPALQFIQGTDEMTIPDVKLTRSRDGSNGMALFSFDQPSVFDSSGEVGEITGLYMIDEEGVIQSTDVNARFVNGKPEGIVAKHIMRSPKEWDRFMRFMERYSDQNGLQFVKKQ

SEQ ID NO: 758 - protein, 479 aa, Arabidopsis thaliana
MDKQPATSWSIHTRPEIIAKYEIFERVGSGAYADVYRARRLSDGLIVALKEIFDYQSAFREIDALTILNGSPNVVVMHEYFWREEENAVLVLEFLRSDLAAVIRDGKRKKKVEGGDGFSVGEIKRWMIQILTGVDACHRNLIVHRDLKPGNMLISDDGVLKLADFGQARILMEHDIVASDENQQAYKLEDKDGETSEPPEVIPDYENSPRQGSDGQEREAMSKDEYFRQVEELKAKQVVRDDTDKDSNVHDGDISCLATCTVSEMDDDLGRNSFSYDADEAVDDTQGLMTSCVGTRWFRPPELLYGSTMYGLEVDLWSLGCVFAELLSLEPLFPGISDIDQISRVTNVLGNLNEEVWPGCVDLPDYKSISFAKVESPLGIEGCLPNHSGDVISLLKKLICYDPASRATTMEMLNDKYLSEEPLPVPVSELYVPPTMSGPDEDSPRKWNDYREMDSDSDFDGFGPMNVKPTSSGFTIEFP

SEQ ID NO: 759 - protein, 321 aa, Arabidopsis thaliana
MKLAGLKSIENAHEDSVWAATWVPATEDRPALLLTGSLDETVKLWRPDELDLVRTNTGHSLGVAALAAHPSGIIAASSSIDSFVRVFDVDTNATIAVLEAPPSEVWGMQFEPKGTILAVAGGSSASVKLWDTASWRLISTLSIPRPDAPKPSDKTSSKKFVLSVAWSPNGKRLACGSMDGTICVFDVDRSKLLHQLEGHNMPVRSLVFSPVDPRVLFSGSDDGHVNMHDAEGKTLLGSMSGHTSWVLSVDASPDGGAIATGSSDRTVRLWDLKMRAAIQTMSNHNDQVWSVAFRPPGGTGVRAGRLASVSDDKSVSLYDYS

SEQ ID NO: 760 - protein, 448 aa, Arabidopsis thaliana
MASRIADSLFAFTGPQQCLPRVPKLAASSARVSPGVYAVKPIDLLLKGRTHRSRRCVAPVKRRIGCIKAVAAPVAPPSADSAEDREQLAESYGFRQIGEDLPENVTLKDIMDTLPKEVFEIDDLKALKSVLISVTSYTLGLFMIAKSPWYLLPLAWAWTGTAITGFFVIGHDCAHKSFSKNKLVEDIVGTLAFLPLVYPYEPWRFKHDRHHAKTNMLVHDTAWQPVPPEEFESSPVMRKAIIFGYGPIRPWLSIAHWVNWHFNLKKFRASEVNRVKISLACVFAFMAVGWPLIVYKVGILGWVKFWLMPWLGYHFWMSTFTMVHHTAPHIPFKPADEWNAAQAQLNGTVHCDYPSWIEILCHDINVHIPHHISPRIPSYNLRAAHESIQENWGKYTNLATWNWRLMKTIMTVCHVYDKEENYIPFDRLAPEESQPITFLKKAMPNYTA

SEQ ID NO: 761 - protein, 499 aa, Arabidopsis thaliana
MDLLLIIAGLVAAAAFFFLRSTTKKSLRLPPGPKGLPIIGNLHQMEKFNPQHFLFRLSKLYGPIFTMKIGGRRLAVISSAELAKELLKTQDLNFTARPLLKGQQTMSYQGRELGFGQYTAYYREMRKMCMVNLFSPNRVASFRPVREEECQRMMDKIYKAADQSGTVDLSELLLSFTNCVVCRQAFGKRYNEYGTEMKRFIDILYETQALLGTLFFSDLFPYFGFLDNLTGLSARLKKAFKELDTYLQELLDETLDPNRPKQETESFIDLLMQIYKDQPFSIKFTHENVKAMILDIVVPGTDTAAAVVVWAMTYLIKYPEAMKKAQDEVRSVIGDKGYVSEEDIPNLPYLKAVIKESLRLEPVIPILLHRETIADAKIGGYDIPAKTIIQVNAWAVSRDTAAWGDNPNEFIPERFMNEHKGVDFKGQDFELLPFGSGRRMCPAMHLGIAMVEIPFANLLYKFDWSLPKGIKPEDIKMDVMTGLAMHKKEHLVLAPTKHI

SEQ ID NO: 762 - protein, 570 aa, Arabidopsis thaliana [sequence omitted]

SEQ ID NO: 763 - protein, 380 aa, Arabidopsis thaliana
MIHQVDAIVNLAATTKFDERYDVALGINTLGALNVLNFAKRCAKVKILVHVSTAYVCGEKSGLIMETPYRMGETLNGTTGLDINYEKKLVQEKLDQLRVIGAAPETITETMKDLGLRRAKMYGWPNTYVFTKAMGEMMVGTKRENLSLVLLRPSIITSTFKEPFPGWTEGIRTIDSLAVGYGKGKLTCFLCDLDAVSDVMPADMVVNSILVSMAAQAGKQEEIIYHVGSSLRNPMKNSKFPELAYRYFSIKPWTNKEGKVVKVGAIEILSSMRSFHRYMTIRYLIALKGLELVNIILCKLFEKEFQYFNKKINFIFRLVDLYQPYLFFYGIFDDSNTEKLRKMVSKTGVENEMFYFDPKVLDWDDYFLNTHVIGLLKYVF

SEQ ID NO: 764 - protein, 113 aa, Arabidopsis thaliana
MTVKIRLARLGCKHRPFYRVVVADEKSRRDGKQIEVLGFYDPLQGKEDADRVSLKFDRIKYWLSVGAQPTDTVESMLFRAGLIPPKPMVVVGSKNGQKSTSQHVSPITGEILN

SEQ ID NO: 765 - protein, 245 aa, Arabidopsis thaliana
MLSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQECLYKRVRT

SEQ ID NO: 766 - protein, 432 aa, Arabidopsis thaliana; identical to SEQ ID NO: 165

SEQ ID NO: 767 - protein, 319 aa, Arabidopsis thaliana
MAMIFCNTLYSSSSPSYLSPLTSKPSRFSKNLRPRAQFQSMEDHDDHLRRKFMEFPYVSPTRKQLMVDLMSTVENRLQSQLLPCNLPPDVRNFNNPNGSAEASLHIRSGDKSSPIDFVIGSWIHCKIPTGVSLNITSISGFLNSSTKAPNFVVELIQSSSKSLVLILDLPHRKDLVLNPDYLKEYYQDTALDSHRQSLLKLPEVNPYVSPSLFVRSAFSPTASMLKIDAEEEDKLEEILRDHVSPAAKEVLEVWLERCVKEEEEKIVVGEEERMELERRDKSFRRKSIEDDLDLQFPRMFGEEVSSRVVHAIKEAFGVL

SEQ ID NO: 768 - protein, 143 aa, Arabidopsis thaliana
MTSLTYTLDEIEGPFEVDYAAVTVHNFLVGSVYRSCSRSSSSWHRRGYFGPKSIPSAFTQGHVGNKSDQYQGYDNAVALPARGNNEELAKENNKITLSVTKSNPESGEVIGAFESIQPSDTDLGATTPKDVKIQGIWYCQLDE

SEQ ID NO: 769 - protein, 403 aa, Arabidopsis thaliana
MTVVREYDPTRDLVGVEDVERRCEVGPSGKLSLFTDLLGDPICRIRHSPSYLMLVAEMGTEKKEIVGMIRGCIKTVTCGQKLDLNHKSQNDVVKPLYTKLAYVLGLRVSPFHRRQGIGFKLVKMMEEWFRQNGAEYSYIATENDNQASVNLFTGKCGYSEFRTPSILVNPVYAHRVNVSRRVTVIKLEPVDAETLYRIRFSTTEFFPRDIDSVLNNKLSLGTFVAVPRGSCYGSGSGSWPGSAKFLEYPPESWAVLSVWNCKDSFLLEVRGASRLRRVVAKTTRVVDKTLPFLKLPSIPSVFEPFGLHFMYGIGGEGPRAVKMVKSLCAHAHNLAKAGGCGVVAAEVAGEDPLRRGIPHWKVLSCDEDLWCIKRLGDDYSDGVVGDWTKSPPGVSIFVDPREF

SEQ ID NO: 770 - protein, 535 aa, Arabidopsis thaliana
MDIGVHVLGSVTSNENESLGLKELIGTKQDRSGFIGEDCLQRSLKLARTTTRAEEEENLSSSVAAAYCKTMSFHQGIPLMRSASPLSSDSRRQEQMLSFSDKPDALDFSKYVGLDNSSNNKNSLSPFLHQIPPPSYFRSSGGYGSGGMMMNMSMQGNFTGVKGPFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVEVQSGQNQTAAAASKAVTTPQQPVVAGNTNRSNARASSNRSLAIGSQYINPSTESLPNNRGVSIYPSTVNLQPKESPVIHQKHRNNNNPFEFGHISSDSLLNPNTAKTYGSSFLDFSSNQEKHSGNHNHNSWPEELTSDWTQLSMSIPIASSSPSSTHNNNNAQEKTTLSPLRLSRELDLSIQTDETTIEPTVKKVNTWIPISWGNSLGGPLGEVLNSTTNSPTFGSSPTGVLQKSTFCSLSNNSSVSSPIAENNRHNGDYFHYTT

SEQ ID NO: 771 - protein, 228 aa, Arabidopsis thaliana
MPKQKAPRKQLKSYKLKHINKSIQEGDAVLMRSSEPGKPSYVARVEAIETDARGSHAKVRVRWYYRPEESIGGRRQFHGAKEVFLSDHFDFQSADTIEGKCKVHSFSSYTKLDSVGNDDFFCRFEYNSTTGAFDPDRVTVFCKCEMPYNPDDLMVQCEECSEWFHPSCIGTTIEEAKKPDNFYCEECSPQQQNLHNSNSTSNNRDAKVNGKRSLEVTKSKNKHTKRPG

SEQ ID NO: 772 - protein, 563 aa, Arabidopsis thaliana
MDYLLTSPSSLRFSDFISSIPKETDHKWLRFSVNLGDARRSTRTRITCGAISSRRKLAERESAERENRVLVRSLMSRISDREPLVKTLDKYVKVVRCDHCFLLFEELGKSDKWLQCLEVFRWMQKQRWYIPDNGVYSKLISVMGKKGQTRMAMWLFSEMKNSGCRPDASVYNALITAHLHTRDKAKALEKVRGYLDKMKGIERCQPNVVTYNILLRAFAQSGKVDQVNALFKDLDMSPVSPDVYTFNGVMDAYGKNGMIKEMEAVLTRMRSNECKPDIITFNVLIDSYGKKQEFEKMEQTFKSLMRSKEKPTLPTFNSMIINYGKARMIDKAEWVFKKMNDMNYIPSFITYECMIMMYGYCGSVSRAREIFEEVGESDRVLKASTLNAMLEVYCRNGLYIEADKLFHNASAFRVHPDASTYKFLYKAYTKADMKEQVQILMKKMEKDGIVPNKRFFLEALEVFGSRLPGSGSENRKSTRSSRSRDSPKGRGGNQLTEFQDKDNKHVFRAVQDCRKNYLENLSGHDKGSRDESRKPSQEKQPLFASDQNNMMIKEKKELFTRVL

SEQ ID NO: 773 - protein, 290 aa, Arabidopsis thaliana
MAATSAAAAAASSIMGTRVAPGIHPGSGRFTAVFGFGKKKAAPKKSAKKTVTTDRPLWYPGAISPDWLDGSLVGDYGFDPFGLGKPAEYLQFDIDSLDQNLAKNLAGDVIGTRTEAADAKSTPFQPYSEVFGIQRFRECELIHGRWAMLATLGALSVEWLTGVTWQDAGKVELVDGSSYLGQPLPFSISTLIWIEVLVIGYIEFQRNAELDSEKRLYPGGKFFDPLGLAADPEKTAQLQLAEIKHARLAMVAFLGFAVQAAATGKGPLNNWATHLSDPLHTTIIDTFSSS

SEQ ID NO: 774 - protein, 803 aa, Arabidopsis thaliana
MMSVRAINGCSIIRTATSAGGPPVSLFRHRIQRLRASHLREFSKLRLNFPLIRADRRFLGNSDAPSCSTCIHSLVESVSEELESISRRKGSRMRVRASVKVKLTSYGEVLEDKLVNQELEAGLLLEFKKDADRVLLAVLHRRDGKKNWMVFDQNGVSCSIKPQQITYIVPNVYNFDHTGLTDFLQRAQDNLDPQLLEFAWMELLEKNKPVTPEELAEMIYGRADPLESYCAHFLLSQDEIYFSILESKGSRSIYSPRPTEQVEELLRRQRVKEAEDKEFQEFIQLLKSAKKAPSHAKPPKSSWLADDKVQDRIGSLEAYAIDAWASTDQQKLAGTILKSMGLQKTSVSALNLLIDIGYFPVHVNLELLKLNLPTHHSEAITEAAEALLSESSDIDAVRRIDLTHLKVYAIDVDEADELDDALSATRLQDGRIKIWIHVADPARYVTPGSKVDREARRRGTSVFLPTATYPMFPEKLAMEGMSLRQGENCNAVSVSVVLRSDGCITEYSVDNSIIRPTYMLTYESASELLHLNLEEEAELKLLSEAAFIRSQWRREQGAVDTTTLETRIKVVNPEDPEPLINLYVENQADLAMRLVFEMMILCGEVVATFGSQHNIPLPYRGQPQSNIDVSAFAHLPEGPVRSSSIVKVMRAAEMNFRCPVRHGVLGIPGYVQFTSPIRRYMDLTAHYQIKAFLRGGDNFPFSAGELEGIAASVNMQSKVVRKLSNTGLRYWVIEFLRRQEKGKKYTALVLRFVKDRIASLLLVEVGFQATAWVSEGKQVGDEIEVRVEEAHPRDDLILFKEVI

SEQ ID NO: 775 - protein, 1987 aa, Arabidopsis thaliana
MNSRADPGDRYFRVPLENQTQQEFMGSWIPFTPKKPRSSLMVDERVINQDLNGFPGGEFVDRGFCNTGVDHNGVFDHGAHQGVTNLSMMINSLAGSHAQAWSNSERDLLGRSEVTSPLAPVIRNTTGNVEPVNGNFTSDVGMVNGPFTQSGTSQAGYNEFELDDLLNPDQMPFSFTSLLSGGDSLFKVRQYGPPACNKPLYNLNSPIRREAVGSVCESSFQYVPSTPSLFRTGEKTGFLEQIVTTTGHEIPEPKSDKSMQSIMDSSAVNATEATEQNDGSRQDVLEFDLNKTPQQKPSKRKRKFMPKVVVEGKPKRKPRKPAELPKVVVEGKPKRKPRKAATQEKVKSKETGSAKKKNLKESATKKPANVGDMSNKSPEVTLKSCRKALNFDLENPGDARQGDSESEIVQNSSGANSFSEIRDAIGGTNGSFLDSVSQIDKTNGLGAMNQPLEVSMGNQPDKLSTGAKLARDQQPDLLTRNQQCQFPVATQNTQFPMENQQAWLQMKNQLIGFPFGNQQPRMTIRNQQPCLAMGNQQPMYLIGTPRPALVSGNQQLGGPQGNKRPIFLNHQTCLPAGNQLYGSPTDMHQLVMSTGGQQHGLLIKNQQPGSLIRGQQPCVPLIDQQPATPKGFTHLNQMVATSMSSPGLRPHSQSQVPTTYLHVESVSRILNGTTGTCQRSRAPAYDSLQQDIHQGNKYILSHEISNGNGCKKALPQNSSLPTPIMAKLEEARGSKRQYHRAMGQTEKHDLNLAQQIAQSQDVERHNSSTCVEYLDAAKKTKIQKVVQENLHGMPPEVIEIEDDPTDGARKGKNTASISKGASKGNSSPVKKTAEKEKCIVPKTPAKKGRAGRKKSVPPPAHASEIQLWQPTPPKTPLSRSKPKGKGRKSIQDSGKARGPSGELLCQDSIAEIIYRMQNLYLGDKEREQEQNAMVLYKGDGALVPYESKKRKPRPKVDIDDETTRIWNLLMGKGDEKEGDEEKDKKKEKWWEEERRVFRGRADSFIARMHLVQGDRRFSPWKGSVVDSVIGVFLTQNVSDHLSSSAFMSLAARFPPKLSSSREDERNVRSVVVEDPEGCILNLNEIPSWQEKVQHPSDMEVSGVDSGSKEQLRDCSNSGIERFNFLEKSIQNLEEEVLSSQDSFDPAIFQSCGRVGSCSCSKSDAEFPTTRCETKTVSGTSQSVQTGSPNLSDEICLQGNERPHLYEGSGDVQKQETTNVAQKKPDLEKTMNWKDSVCFGQPRNDTNWQTTPSSSYEQCATRQPHVLDIEDFGMQGEGLGYSWMSISPRVDRVKNKNVPRRFFRQGGSVPREFTGQIIPSTPHELPGMGLSGSSSAVQEHQDDTQHNQQDEMNKASHLQKTFLDLLNSSEECLTRQSSTKQNITDGCLPRDRTAEDVVDPLSNNSSLQNILVESNSSNKEQTAVEYKETNATILREMKGTLADGKKPTSQWDSLRKDVEGNEGRQERNKNNMDSIDYEAIRRASISEISEAIKERGMNNMLAVRIKDFLERIVKDHGGIDLEWLRESPPDKAKDYLLSIRGLGLKSVECVRLLTLHNLAFPVDTNVGRIAVRMGWVPLQPLPESLQLHLLELYPVLESIQKFLWPRLCKLDQRTLYELHYQLITFGKVFCTKSRPNCNACPMRGECRHFASAYASARLALPAPEERSLTSATIPVPPESYPPVAIPMIELPLPLEKSLASGAPSNRENCEPIIEEPASPGQECTEITESDIEDAYYNEDPDEIPTIKLNIEQFGMTLREHMERNMELQEGDMSKALVALHPTTTSIPTPKLKNISRLRTEHQVYELPDSHRLLDGMDKREPDDPSPYLLAIWTPGETANSAQPPEQKCGGKASGKMCFDETCSECNSLREANSQTVRGTLLIPCRTAMRGSFPLNGTYFQVNELFADHESSLKPIDVPRDWIWDLPRRTVYFGTSVTSIFRGLSTEQIQFCFWKGFVCVRGFEQKTRAPRPLMARLHFPASKLKNNKT

SEQ ID NO: 776 - protein, 162 aa, Arabidopsis thaliana
MKLKVVYRKVSDYICYDLKEIVLPSSLPDPPHVVKRRKLTWHERFLVLKEASRLYAASWVRDIGPELRPNDYKKQGDAEPKKQAKEAENEPSVLEDLAVAARGGMETLRPALHRLYMTRASNYKDALTSFIKGYHEGLQQVMQNKAESEAPADEADKSKKTT

SEQ ID NO: 777 - protein, 1192 aa, Arabidopsis thaliana
MAFLTALFLFLFFSFSSSAIVDLSSETTSLISFKRSLENPSLLSSWNVSSSASHCDWVGVTCLLGRVNSLSLPSLSLRGQIPKEISSLKNLRELCLAGNQFSGKIPPEIWNLKHLQTLDLSGNSLTGLLPRLLSELPQLLYLDLSDNHFSGSLPPSFFISLPALSSLDVSNNSLSGEIPPEIGKLSNLSNLYMGLNSFSGQIPSEIGNISLLKNFAAPSCFFNGPLPKEISKLKHLAKLDLSYNPLKCSIPKSFGELHNLSILNLVSAELIGLIPPELGNCKSLKSLMLSFNSLSGPLPLELSEIPLLTFSAERNQLSGSLPSWMGKWKVLDSLLLANNRFSGEIPHEIEDCPMLKHLSLASNLLSGSIPRELCGSGSLEAIDLSGNLLSGTIEEVFDGCSSLGELLLTNNQINGSIPEDLWKLPLMALDLDSNNFTGEIPKSLWKSTNLMEFTASYNRLEGYLPAEIGNAASLKRLVLSDNQLTGEIPREIGKLTSLSVLNLNANMFQGKIPVELGDCTSLTTLDLGSNNLQGQIPDKITALAQLQCLVLSYNNLSGSIPSKPSAYFHQIEMPDLSFLQHHGIFDLSYNRLSGPIPEELGECLVLVEISLSNNHLSGEIPASLSRLTNLTILDLSGNALTGSIPKEMGNSLKLQGLNLANNQLNGHIPESFGLLGSLVKLNLTKNKLDGPVPASLGNLKELTHMDLSFNNLSGELSSELSTMEKLVGLYIEQNKFTGEIPSELGNLTQLEYLDVSENLLSGEIPTKICGLPNLEFLNLAKNNLRGEVPSDGVCQDPSKALLSGNKELCGRVVGSDCKIEGTKLRSAWGIAGLMLGFTIIVFVFVFSLRRWAMTKRVKQRDDPERMEESRLKGFVDQNLYFLSGSRSREPLSINIAMFEQPLLKVRLGDIVEATDHFSKKNIIGDGGFGTVYKACLPGEKTVAVKKLSEAKTQGNREFMAEMETLGKVKHPNLVSLLGYCSFSEEKLLVYEYMVNGSLDHWLRNQTGMLEVLDWSKRLKIAVGAARGLAFLHHGFIPHIIHRDIKASNILLDGDFEPKVADFGLARLISACESHVSTVIAGTFGYIPPEYGQSARATTKGDVYSFGVILLELVTGKEPTGPDFKESEGGNLVGWAIQKINQGKAVDVIDPLLVSVALKNSQLRLLQIAMLCLAETPAKRPNMLDVLKALKEI

SEQ ID NO: 778 - protein, 383 aa, Arabidopsis thaliana
MEESRESPAEHGYYMPAEWDSHAQTWIGWPERQDNWRHNALPAQRVFADVAKAISKFEPVTVCASPAQWENARKQLPEDIRVVEMSMNDSWFRDSGPTFIVRKRPVKLSSLNRNIAGIDWNFNAWGGANDGCYNDWSHDLLVSRKILALERIPRFQHSMILEGGSIHVDGEGTCLVTEECLLNKNRNPHMSKEQIEEELKKYLGVQSFIWLPRGLYGDEDTNGHIDNMCCFARPGVVLLSWTDDETDPQYERSVEALSVLSNSIDARGRKIQVIKLYIPEPLYMTEEESSGITQDGEAIPRLAGTRLAASYVNFYIANGGIIAPQFGDPIRDKEAIRVLSDTFPHHSVVGIENAREIVLAGGNIHCITQQQPAEPTSVAENGH

SEQ ID NO: 779 - protein, 167 aa, Arabidopsis thaliana
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQIFLG

SEQ ID NO: 780 - protein, 362 aa, Arabidopsis thaliana
MGDSFIRPHLRQLAAYQPILPFEVLSAQLGRKPEDIVKLDANENPYGPPPEVFEALGNMKFPYVYPDPQSRRLRDALAQDSGLESEYILVGCGADELIDLIMRCVLDPGEKIIDCPPTFSMYVFDAAVNGAGVIKVPRNPDFSLNVDRIAEVVELEKPKCIFLTSPNNPDGSIISEDDLLKILEMPILVVLDEAYIEFSGVESRMKWVKKYENLIVLRTFSKRAGLAGLRVGYGAFPLSIIEYLWRAKQPYNVSVAGEVAALAALSNGKYLEDVRDALVRERERLFGLLKEVPFLNPYPSYSNFILCEVTSGMDAKKLKEDLAKMGVMVRHYNSQELKGYVRVSAGKPEHTDVLMECLKQFY

SEQ ID NO: 781 - protein, 249 aa, Arabidopsis thaliana
MKFNVANPTTGCQKKLEIDDDQKLRAFFDKRLSQEVSGDALGEEFKGYVFKIMGGCDKQGFPMKQGVLTPGRVRLLLHRGTPCFRGHGRRTGERRRKSVRGCIVSPDLSVLNLVIVKKGVSDLPGLTDTEKPRMRGPKRASKIRKLFNLGKEDDVRKYVNTYRRTFTNKKGKKVSKAPKIQRLVTPLTLQRKRARIADKKKRIAKANSDAADYQKLLASRLKEQRDRRSESLAKKRSRLSSAPAKPVAA

SEQ ID NO: 782 - protein, 196 aa, Arabidopsis thaliana
MVLYLAITTLKETGYENVYDAIEKPLQLAQTAAVLEILHGLVGLVRSPVSATLPQIGSRLFLTWGILYSFPEVRSHFLVTSLVISWSITEIIRYSFFGFKEALGFAPSWHLWLRYSSFLLLYPTGITSEVGLIYLALPHIKTSEMYSVRMPNILNFSFDFFYATILVLAIYVPGSPHMYRYMLGQRKRALSKSKRE

SEQ ID NO: 783 - protein, 80 aa, Arabidopsis thaliana
MAAMKYKGSVFIILVILLLSSSLLAHSSSTKSFFWLGETQDTKAMKKEKKIDGGTANEVEERQVPTGSDPLHHKHIPFTP

SEQ ID NO: 784 - protein, 970 aa, Arabidopsis thaliana
MILKTAFSLPTPTTTLLSPSSPHQLNTLFFTRRRRRLISPSRLNSIFSQRRFSFSAAASGNNVFTSPETSKTFDFSSEEKIYKWWESQGYFKPNFDQGGSPFVIPMPPPNVTGSLHMGHAMFVTLEDIMVRYNRMNGRPTLWLPGTDHAGIATQLVVEKMLASEGIKRVDLGRDEFTKRVWEWKEKYGGTITNQIKRLGASCDWSRERFTLDEQLSRAVVEAFVKLHDKGLIYQGSYMVNWSPNLQTAVSDLEVEYSEEPGFLYHIKYRVAGSPDFLTIATTRPETLFGDVALAVHPEDDRYSKYVGQTAIVPMTYGRHVPIIADKYVDKDFGTGVLKISPGHDHNDYLLARKLGLPILNVMNKDATLNDVAGLFWFEVREKLWADLEEIGLAVKKEPHTLRVPRSQRGGEVIEPLVSKQWFVHMDPLAEKALLAVENKELTIIPERFEKIYNHWLTNIKDWCISRQLWWGHRIPVWYVVGKDCEEDYIVAKSAEEALEKALEKYGKDVEIYQDPDVLDTWFSSSLWPFSTLGWPDVAAKDFNNFYPTNMLETGHDILFFWVARMVMMGIEFTGTVPFSHVYLHGLIRDSQGRKMSKSLGNVIDPLDTIKDFGTDALRFTIALGTAGQDLNLSTERLTANKAFTNKLWNAGKFVLHSLPSLSDTSAWENLLDLKLDKEETLLSLPLPECWAVSKLHILIDSVTASYEKLFFGDVGRETYDFFWSDFADWYIEASKSRLYGSGGNSVSLASQAVLLYVFENILKLLHPFMPFVTEDLWQALPYRKEALIVSPWPQNSLPRNVESIKRFENLQALTRAIRNARAEYSVEPVKRISASVVGSAEVIEYISKEKEVLALLSRLDLNNVHFSNAPPGDANLSVHLVASEGLEAYLPLAAMVDISSEVQRISKRLSKMQTEYDALITRLSSPKFVEKAPEEVVRGVKEQVEELEEKIKLTKARLDFLKSTTSLVSQ

SEQ ID NO: 785 - protein, 326 aa, Arabidopsis thaliana
MAGLLKTPSLHLTPTLLHAPSVPFKPFCVSFAGGRNVSVSLSRRASLRSVSSGYPLRLLNLVPFASGEAETTETEVESNEPEVQETDGAVDVENENASAEEGEAEEEEAAVITALLKSYKEALADNNEGKIAEIEASLKSIEDEKFLLADKVASLSNELSVERDRLIRISADFDNFRKRTERERLNLVSNAQGEVVENLLAVLDNFERAKSQIKVETEGEEKVTNSYQSIYKQFVEILGSLGVIHVETVGKQFDPMLHEAIMREDSAEYEEGIVLEEYRKGFLLGERLLRPSMVKVSAGPGPEKPLEAEGEEATAQGSAEEESSSS

SEQ ID NO: 786 - protein, 1366 aa, Arabidopsis thaliana
MNQYHIYEAIGHGKCSTVYKGRKKKTIEYFACKSVDKSRKNKVLQEVRILHSLNHPNVLKFYAWYETSAHMWLVLEYCVGGDLRTLLQQDCKLPEESIYGLAYDLVIALQYLHSKGIIYCDLKPSNILLDENGHIKLCDFGLSRKLDDISKSPSTGKRGTPYYMAPELYEDGGIHSFASDLWALGCVLYECYTGRPPFVAREFTQLVKSIHSDPTPPLPGNASRSFVNLIESLLIKDPAQRIQWADLCGHAFWKSKINLVQLPTQPAFDDMIGINTKPCLSERNGDRPNKTPPKYREKDRKGGSKQNENSIQGSKGHETPIKGTPGGSKAQAKLPSRATEEKHGGRPAANRQVNILRLSRIAKANLQKENEKENYRRPLPNSNENCAEVKIDNTDMELDFDENNDDEGPDESEGTENTSCAQEERVMSHNENHRRQRVVSSNVPDENSSANETPTLGEARDCHEDQSEPMDMSAAPPSASPQLKTHRGRETSGVAVNHDSSKAPTSLTDVFWHISDLSVRPVMPSRKSDKEAVHSLSFETPQPSDFSKKGKQELEPLNNRIITVLSGSSSGLSEKQNLIRYLETLSTNADAANILTNGPIMLVLVKVLRLSKTPAFRVQIASLIGLLIRHSTSIEDDLANSGILDSLTNGLRDKHEKVRRFSMAALGELLFYISTQNEHKDFKPPESPSKETRSASGWQVSNALISLVSSVLRKGEDDLTQVYALRTIENICSQGAYWATRFSSQDLISNLCYIYKATGKQESMRQTAGSCLVRLARFNPPCIQTVVEKLSLKEIASSFVKGSAREQQVCLNLLNMAMIGSHTFTSFGRHLVTLTEEKNLFPSLLSIIEQGTEVLRGKALLFVAFLCKNSRRWLTNFFCNARFLPVVDRLAKEKDSYLQQCLEAFVNVIASIIPGMLDTITNDIQQLMTGRRHGPVSPLNSRAPVKTNAHLFPVVLHLLGSSSFKNKMVTPQVLRQLANLTKLVEASFQGRDDFRVTLLQVLECITGDAPLVTQNGEIIIREILPSLAAIYNGNKDGDARFLCLKIWFDSLTILLTECTEIEQQISEDLKSISNSHFLPLYPALIQDEDPIPAYAQKLLVMLVEFDYIKISNLLRHNTVSQCFEFLLGDLSSANVNNVKLCLALASAPEMESKLLSQLKVVRRIGNLLEFVNAKDMEDFLEPTLSLCRAFLLRSLGNKKGLSSNYTKEPTLLSEASFTFEVDPQECIRDIADFGSNIGLFLHFAGLDDDTSIAVADIASECVVLLLKAASREATTGFLTNLPKITPILDSWRRRKSTELHLLVLKRVLHCLGYACKQYLSQAMILSISGHDVSKINAIVSEMKNSDAAGLNSIASLVAMELQRLPR

SEQ ID NO: 787 - protein, 340 aa, Arabidopsis thaliana
MDTKAVGVSKDTAASMEASTVFPGFKFSPTDVELISYYLKRKMDGLERSVEVIPDLEIYNFEPWDLPDKSIVKSDSEWFFFCARGKKYPHGSQNRRATKMGYWKATGKERDVKSGSEVIGTKRTLVFHIGRAPKGERTDWIMHEYCVKGVSLDDAMVVCRVRRNKEYNSGTSQKAPKPNSSAEKHAKVQNGATSSGSPSDWDNLVDFYLAGESGEKLLAEMAESSENLQVDNDEDFFADILRDEIINLDEAVMTGNTPNEVPTLESASMEIRVLPLPNMIDKQMSSLLEERPSQKKKGKDATESLSSCFVGLYSIKSVNKARWDVIIGVVALIAMLFYLE

SEQ ID NO: 788 - protein, 298 aa, Arabidopsis thaliana
MVFGQVVIGPPGSGKTTYCNGMSQFLSLMGRKVAIVNLDPANDALPYECGVNIEELIKLEDVMSEHSLGPNGGLVYCMEYLEKNIDWLESKLKPLLKDHYILFDFPGQVELFFIHDSTKNVLTKLIKSLNLRLTAVQLIDSHLCCDPGNYVSSLLLSLSTMLHMELPHVNVLSKIDLIGSYGKLAFNLDFYTDVQDLSYLEHHLSQDPRSAKYRKLTKELCSVIEDYSLVNFTTLDIQDKESVGDLVKLIDKSNGYIFAGIDASVVEYSKIAIGQTDWDYNRVAAVQEKYMEDEEIQD

SEQ ID NO: 789 - protein, 325 aa, Arabidopsis thaliana
MASSSCFLRSILFSSPTNLRSNHHLPTFFPKNYLICSHSTSSRFESLSVSSIGTGSTKKSSDTRRKVKSMATTNIGKEEKKRVEIYDLEENLVIDLAKFTADLSDKFCKERGAFTVVVSGGSLIKSLRKLVESPYVDSIDWARWHFFWVDERVVPKNHDDSNYKLAYDSFLSKVPIPPGNVYAINEALSAEAAADDYETCLKHLVNTNILRVSESTGFPKFDLMLLGMGPDGHVASLFPGHGLCNESKKWVVSISDSPKPPSERITFTFPVINSSAHVALVVCGSGKAEAVEAALKKTGNVPPAGSVSAEDELVWFLDKPASSKL

SEQ ID NO: 790 - protein, 667 aa, Arabidopsis thaliana
MWQTWPRQPILLDIFSNPNTLSTTVRSWSVRHPLSIITVKTFARFFLDIFFSPHYYRKNKVLFFALFSFISPLTNILICFVTVSLSLELSSSSSIIDLGFSKLSVCVVIMTSSEEVVEVTVVKAPEAGGGKLSRRKIRKKDAGVDGLVKWERFLPKIALRVLLVEADDSTRQIIAALLRKCSYRVAAVPDGLKAWEMLKGKPESVDLILTEVDLPSISGYALLTLIMEHDICKNIPVIMMSTQDSVNTVYKCMLKGAADYLVKPLRRNELRNLWQHVWRRQTSLAPDSFPWNESVGQQKAEGASANNSNGKRDDHVVSGNGGDAQSSCTRPEMEGESADVEVSARDAVQMECAKSQFNETRLLANELQSKQAEAIDFMGASFRRTGRRNREESVAQYESRIELDLSLRRPNASENQSSGDRPSLHPSSASAFTRYVHRPLQTQCSASPVVTDQRKNVAASQDDNIVLMNQYNTSEPPPNAPRRNDTSFYTGADSPGPPFSNQLNSWPGQSSYPTPTPINNIQFRDPNTAYTSAMAPASLSPSPSSVSPHEYSSMFHPFNSKPEGLQDRDCSMDVDERRYVSSATEHSAIGNHIDQLIEKKNEDGYSLSVGKIQQSLQREAALTKFRMKRKDRCYEKKVRYESRKKLAEQRPRIKGQFVRQVQSTQAP

SEQ ID NO: 791 - protein, 748 aa, Arabidopsis thaliana
MASTVGVPSLYQVPHLEISKPNSKKRSNCLSLSLDKPFFTPLSLVRRTRRIHSSSLLVPSAVATPNSVLSEEAFKSLGLSDHDEYDLDGDNNNVEADDGEELAISKLSLPQRLEESLEKRGITHLFPIQRAVLVPALQGRDIIARAKTGTGKTLAFGIPIIKRLTEEAGDYTAFRRSGRLPKFLVLAPTRELAKQVEKEIKESAPYLSTVCVYGGVSYTIQQSALTRGVDVVVGTPGRIIDLIEGRSLKLGEVEYLVLDEADQMLAVGFEEAVESILENLPTKRQSMLFSATMPTWVKKLARKYLDNPLNIDLVGDQDEKLAEGIKLYAIATTSTSKRTILSDLITVYAKGGKTIVFTQTKRDADEVSLALSNSIATEALHGDISQHQRERTLNAFRQGKFTVLVATDVASRGLDIPNVDLVIHYELPNDPETFVHRSGRTGRAGKEGSAILMHTSSQKRTVRSLERDVGCHFEFISPPTVGDLLESSADQVVATLNGVHPDSIKFFSATAQKLYEEKGTDALAAALAHLSGFSQPPSSRSLLSHEKGWVTLQLIRDPTNARGFLSARSVTGFLSDLYRTAADEVGKIFLIADDRIQGAVFDLPEEIAKELLEKDVPEGNSLSMITKLPPLQDDGPSSDNYGRFSSRDRMPRGGGGSRGSRGGRGGSSRGRDSWGGDDDRGSRRSSGGGSSWSRGGSSSRGSSDDWLIGGRSSSSSRAPSRERSFGGSCFICGKSGHRATDCPDKRGF

SEQ ID NO: 792 - protein, 129 aa, Arabidopsis thaliana
MLPLSLLKTAQGHPMLVELKNGETYNGHLVNCDTWMNIHLREVICTSKDGDRFWRMPECYIRGNTIKYLRVPDEVIDKVQEEKTRTDRKPPGVGRGRGRGVDDGGARGRGRGTSMGKMGGNRGAGRGRG

SEQ ID NO: 793 - protein, 548 aa, Arabidopsis thaliana
MGTLTSVAFAAAVNIRFRSFHRENIKTTITTLPKWQKRLCFSSTEDSHRFRIAKCLGNDENSNRDDSIGENGETHKSSVVKTATFEEEDEETSKSSSTTSSSNEFGSDKTSMPSTIDPTYSSFQIDSFKLMELLGPEKVDPADVKLIKDKLFGYSTFWVTKEEPFGDLGEGILFLGNLRGKKEDVFAKLQRKLVEVASDKYNLFMIEEPNSEGPDPRGGARVSFGLLRKEVSEPGPTTLWQYVIALILFLLTIGSSVELGIASQINRLPPEVVKYFTDPNAVEPPDMELLYPFVDAALPLAYGVLGILLFHELGHFLAAVPKKVKLSIPYFIPNITLGSFGAITQFKSILPDRSTKVDISLAGPFAGAALSVSMFAVGLFLSTEPDAANDLVQVPSMLFQGSLLLGLISRATLGYAALHAATVSIHPLVIAGWCGLTTTAFNMLPVGCLDGGRAVQGAFGKNALVTFGLSTYVMLGLRVLGGPLALPWGLYVLICQRTPEKPCLNDVTEVGTWRKALVGIALILVVLTLLPVWDELAEEVGIGLVTTF

SEQ ID NO: 794 - protein, 285 aa, Arabidopsis thaliana
MEGSKSEAVFDSMNLNPQIFINEAINSVEDYVDQAFDFYARDASKSLKIKGSDKQKSQALSNGIARVRGLLLSVIDNRLKLWESYSLRFCFAVPDGFVLPKSEESSSVHQDGLYDLELDAELDSLRDKLNVVGKRSVELDSELQALERSSVSRERSLRLVNEALELYDESSMDEIFKEMTKMASELRASVERLKTRRMKASESAKVKRLKNHGKEFSAMTFDYVVSGLPNGGSRQKPVIPPDQKPQHIILVSSQVSLELATSKLRLGSLPIELTTLDYFCMCFIM

SEQ ID NO: 795 - protein, 430 aa, Arabidopsis thaliana
MAQILAASPTCQMRVPKHSSVIASSSKLWSSVVLKQKKQSNNKVRGFRVLALQSDNSTVNRVETLLNLDTKPYSDRIIAEYIWIGGSGIDLRSKSRTIEKPVEDPSELPKWNYDGSSTGQAPGEDSEVILYPQAIFRDPFRGGNNILVICDTWTPAGEPIPTNKRAKAAEIFSNKKVSGEVPWFGIEQEYTLLQQNVKWPLGWPVGAFPGPQGPYYCGVGADKIWGRDISDAHYKACLYAGINISGTNGEVMPGQWEFQVGPSVGIDAGDHVWCARYLLERITEQAGVVLTLDPKPIEGDWNGAGCHTNYSTKSMREEGGFEVIKKAILNLSLRHKEHISAYGEGNERRLTGKHETASIDQFSWGVANRGCSIRVGRDTEAKGKGYLEDRRPASNMDPYIVTSLLAETTLLWEPTLEAEALAAQKLSLNV

SEQ ID NO: 796 - protein, 1051 aa, Arabidopsis thaliana
MGEESEIAMASADRNNLTQKIAKILNETRTSYATHNRKLKELATIRSKLSSSESESESVSSSILQFSSVFLKTLTPLFIAAQRRTAAAERVVRFVAEFACLRSNSDGDSDCDEFLEEFLKFLVAGSVAANRNARFRACQIISEIILRLPDEVEVADELWDDVIDCMMLRVRDKVPVIRTFAVRSLSRFVNDPENSDILDLLLEVLPLEQNPEVRKTIVLSLPPSNATTQAIIDCTLDVNESVRKAAYSVLANKVPLQSLSIKLRTTILQRGLADRAVNVSTECLKLMKEQWLANYCEGDPITFLKYLDVETYESVAESALEVLLSEGLIMPSDDKSIQQYILSADGETRDESTCSAPSIQLMEPEIALYWRIICRKVHQSAQAKGSDAATAMGAEAAVYAAEASDANDLLERILPATVSDYVDLVKAHIEAGPNHHFASRQLLLLGTMLDFSDAMLHKTVSSFVQELLRRPFEQELDEDGNSIVIGDGINLGGDKDWAEAVSKLAKKVHAAPGEYEEVILVVVEEVARPCRERTADFLQWMHMLSLTSLLLENGKSLHSLQGKAIEPEEILHALLLPGAKHTHLDVQRIAIKGLGLFGLLEKKPSEELVRQLRAAFCRSPPPISIMACKALVDLGMWHSPTEVDKAMGQDLLSQFEDDSIDFAPIDLSNAEEDMNFKMLDLLYAGLESDDWRASTESSENESVKATVGEGFAKLLLLGEKYPNLPASFYPFVLGKLIALYFSEESKEQLRFKQCLSVFFEHYASLSEKHKGYVSKAFVPLVRSMWPGIDGNTKSSSYVVSNQRKRAVQVSRFILQMMQTPLYKKETRGEPESQVNKSPEDSIQHPLNCTEEGLAIRIAIEMLSFKEKKTAHEKAYVAALCKILVLLHLKPSEQNVTKLLKKLLSLLADSVRSEKDLLKEVKPVLQHLKSLDACPSEELTQDQANSIFEILGVSYNLEITETTTVPQTPAPCSTKPARSRRRARIEETSSDEEEVASPPPSAPNTLMTRSHRASKAAALAKIMASKVKMSNVDEDDEEEEGSSDVTADDSDE

SEQ ID NO: 797 - protein, 149 aa, Arabidopsis thaliana
MADQLTDEQISEFKEAFSLFDKDGDGCITTKELGTVMRSLGQNPTEAELQDMINEVDADGNGTIDFPEFLNLMAKKMKDTDSEEELKEAFRVFDKDQNGFISAAELRHVMTNLGEKLTDEEVEEMIREADVDGDGQINYEEFVKIMMAK

SEQ ID NO: 798 - protein, 286 aa, Arabidopsis thaliana
MVGAAILESPGEGIGSNSILSQKRQLSSSDAAKRDAKKRSTMLMDLEILDCPICYEAFTIPIFQCDNGHLACSSCCPKLNNKCPACTSPVGHNRCRAMESVLESILIPCPNAKLGCKKNVSYGKELTHEKECMFSHCACPALDCNYTSSYKDLYTHYRITHMEINQINTFICDIPLSVRMNISKKILIRTEHLTNHLFAVQCFREPYGVYVTVSCIAPSSPELSQYSYALSYTVDGHTVIYQSPEVKRVLKLSFQTPQENFMLIPNSLLRGDVLEMRISVKKLNKE

SEQ ID NO: 799 - protein, 334 aa, Arabidopsis thaliana
MVLVMDDEESNNVERYDDVVLPGFRFHPTDEELVSFYLKRKVLHKSLPFDLIKKVDIYKYDPWDLPTMGEKEWYFYCPRDRKYRNSTRPNRVTGGGFWKATGTDRPIYSLDSTRCIGLKKSLVFYRGRAAKGVKTDWMMHEFRLPSLSDSHHSSYPNYNNKKQHLNNNNNSKELPSNDAWAICRIFKKTNAVSSQRSIPQSWVYPTIPDNNQQSHNNTATLLASSDVLSHISTRQNFIPSPVNEPASFTESAASYFASQMLGVTYNTARNNGTGDALFLRNNGTGDALVLSNNENNYFNNLTGGLTHEVPNVRSMVMEETTGSEMSATSYSTNN

SEQ ID NO: 800 - protein, 482 aa, Arabidopsis thaliana
MPVVTRLIRLKCVGLRLDRSGLNRRICHGGHGESTRRRVMEELSSLTVSQREQFLVENDVFGIYNYFDASDVSTQKYMMEIQRDKQLDYLMKGLRQLGPQFSSLDANRPWLCYWILHSIALLGETVDDELESNAIDFLGRCQGSEGGYGGGPGQLPHLATTYAAVNALVTLGGDKALSSINREKMSCFLRRMKDTSGGFRMHDMGEMDVRACYTAISVASILNIMDDELTQGLGDYILSCQTYEGGIGGEPGSEAHGGYTYCGLAAMILINEVDRLNLDSLMNWAVHRQGVEMGFQGRTNKLVDGCYTFWQAAPCVLLQRLYSTNDHDVHGSSHISEGTNEEHHAHDEDDLEDSDDDDDSDEDNDEDSVNGHRIHHTSTYINRRMQLVFDSLGLQRYVLLCSKIPDGGFRDKPRKPRDFYHTCYCLSGLSVAQHAWLKDEDTPPLTRDIMGGYSNLLEPVQLLHNIVMDQYNEAIEFFFKAA

SEQ ID NO: 801 - protein, 306 aa, Arabidopsis thaliana
MTIPVPLESLFPLLHRSVNCSFLPGGAILISGDFSDFIVEQDLFDNVGFEIARLVARLVFFSLSGAEICFCYIPESAMSKRAAEEMTPSLESNRTGPDFFGYYRAQVEELLSQEEKIPHHNHVDAKKSSAEIIGAELSDVKQEKLNALLRQCVLNSIPEVDEMQSRVDSMYLMSQLSNKKRSTLPTNAESVIPEDPRCKEVEDDLRLLMKSDPSLVKEIVGKHSSDLLARLNERQQHLEKLLDNVSINRPMSRGEKRDLQKSIKELPAKNLERVAGIIKNHYVALGKEMPDDVFVINMEEEVGFLT

SEQ ID NO: 802 - protein, 530 aa, Arabidopsis thaliana
MRTLWNHFSTISYIKISPRMRRISAANLISNRNLSTISSTEDPELRDFVGFLESLKNYEKSGVPKGAGTDSDDGFDLGRMKRLMLRLRNPHYKYKVVHVAGTKGKGSTSAFLSNILRAGGYSVGCYSSPHILSIKERISCNGEPVSASTLNDLFYSVKPILEQSIQEENGSLSHFEILTGIAFSLFEKENVDIAVIEAGLGGARDATNVIESSNLAASVITTIGEEHMAALGGSLESIAEAKSGIIKHGRPVVLGGPFLPHIEGILRSKAASVSSSVILASNIGSSSSIKGIINKNGIGLCQSCDIVIQNEKDDQPIVELSDVNLRMLGHHQLQNAVTATCVSLCLRDQGCGRVTDEAIRIGLENTRLLGRSQFLTPKEAETLLLPGATVLLDGAHTKESARALKEMIKKDFPEKRLVFVVAMASDKDHVSFAKELLSGLKPEAVILTEADIGGGKIRSTESSVLKESWIKAADELGSRSMEASENKTVLGSLKLAYKILSDDTTSSDSGMVIVTGSLHIVSSVLASLQH

SEQ ID NO: 803 - protein, 171 aa, Arabidopsis thaliana
MSTVRKITLKSSDGENFEIDEAVALESQTIKHMIEDDCTDNGIPLPNVTSKILSKVIEYCKRHVEAAEKSETTADAAAATTTTTVASGSSDEDLKTWDSEFIKVDQGTLFDLILAANYLNIKGLLDLTCQTVADMIKGKTPEEIRKTFNIKNDFTPEEEEEVRRENQWAFE

SEQ ID NO: 804 - protein, 355 aa, Arabidopsis thaliana
MADEKENCVRMTRAATKRKASMEAAIDKERINKKRVVLGELPNLSNIKKSRKATTKQKKKSVSIPTIETLNSDIDTRSDDPQMCGPYVTSIFEYLRQLEVKSRPLVDYIEKIQKDVTSNMRGVLVDWLVEVAEEYKLLSDTLYLAVSYIDRFLSLKTVNKQRLQLLGVTSMLIASKYEEITPPNVDDFCYITDNTYTKQEIVKMEADILLALQFELGNPTSNTFLRRFTRVAQEDFEMSHLQMEFLCSYLSELSMLDYQSVKFLPSTVAASAVFLARFIIRPKQHPWNVMLEEYTRYKAGDLKECVAMIHDLYLSRKCGALEAIREKYKQHKFKCVATMPVSPELPLTVFEDVNI

SEQ ID NO: 805 - protein, 418 aa, Arabidopsis thaliana
MASLLGRSPSSILTCPRISSPSSTSSMSHLCFGPEKLSGRIQFNPKKNRSRYHVSVMNVATEINSVEQAKKIDSKESARPVYPFAAIVGQDEMKLCLLLNVIDPKIGGVMIMGDRGTGKSTTVRSLVDLLPEITVVSGDPYNSDPRDPECMGKEVREKVQKGEELSVIETKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDSNPKEFRETYQEEQLKLQEQITTARSNLSAVQIDQDLKVKISKVCAELDVDGLRGDMVINRAARALAALQGRDQVTAEDVGIVIPNCLRHRLRKDPLESMDSGILVTEKFYEVFT

SEQ ID NO: 806 - protein, 258 aa, Arabidopsis thaliana
MSISMALFSPPISSSLQNPNLIPKISTSLLSTKRFSLISVPRASSDNGTTSPVVEIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSTVSSKK

SEQ ID NO: 807 - protein, 490 aa, Arabidopsis thaliana
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWK

SEQ ID NO: 808 - protein, 253 aa, Arabidopsis thaliana
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 809 - protein, 222 aa, Arabidopsis thaliana
MGKYMKKSKITGDISVMEVSKATAPSPGVRTRAAKTLALKRLNSSAADSALPNDSSCYLQLRSRRLEKPSSLIEPKQPPRVHRSGIKESGSRSRVDSVNSVPVAQSSNEDECFDNFVSVQVSCGENSLGFESRHSTRESTPCNFVEDMEIMVTPGSSTRSMCRATKEYTREQDNVIPTTSEMEEFFAYAEQQQQRLFMEKYNFDIVNDIPLSGRYEWVQVKP

SEQ ID NO: 810 - protein, 955 aa, Arabidopsis thaliana
MSSFFKSFAGNPREAAAMAMVQSSSYRVLSGKSCSNLRRNTPLDSFLAKGRSSVKAFSFLYVSRFSTEPNNEFGHSSKRRSRGPVMAAKKASEGEKQEDGKYKQTVDLPKTGFGMRANSLTREPELQKLWEENQVFKRVSDNNNGGSFILHDGPPYANGDLHMGHALNKILKDIINRYKLLQNYKVQYVPGWDCHGLPIELKVLQSLDQEVRKELTPLKLRAKAAKFAKATVKTQMESFKRFGVWADWNNPYLTLDPEYEAAQIEVFGQMALKGYIYRGRKPVHWSPSSRTALAEAELEYPEGHISKSIYAIFKLVGGAKTSLLDEFIPNIYLAVWTTTPWTMPANAAVAVNAKLQYSVVEVQSFSEDESTVTSNKKKIPGKVLKNQQKLFVIVATDLVPALEAKWGVKLSISKTFLGSDLENCRYTHPIDNRDCPVVIGGDYITTESGTGLVHTAPGHGQEDYATGLKYGLPLVSPVDDEGKFTEEAGQFRGLSVLGEGNTAVVSYLDENMSLVMEESYAHKYPYDWRTKKPTIFRATEQWFASVEGFRTATMDAINNVKWVPHQAVNRISAMTSSRSDWCISRQRTWGVPIPAFYHVKTKEPLMNEETINHVKSIISQKGSDAWWYMSVEDLLPEKYRDKAADYEKGTDTMDVWFDSGSSWAGVLGKREGLSFPADVYLEGTDQHRGWFQSSLLTSIATQGKAPYSAVITHGFVLDEKGMKMSKSLGNVVDPRLVIEGGKNSKDAPAYGADVMRLWVSSVDYTGDVLIGPQILRQMSDIYRKLRGTLRYLLGNLHDWRVDNAVPYQDLPIIDQHALFQLENVVKNIQECYENYQFFKIFQIIQRFTIVDLSNFYFDIAKDRLYTGGTSSFTRRSCQTVLSTHLLSILRVIAPIVPHLAEDVWQNLPFEYRNEDGSAAEFVFELKWPTLNEQWLSFPAEDVLFWQRLLEVSKLS

SEQ ID NO: 811 - protein, 556 aa, Arabidopsis thaliana
MWRRSFSTLPKKKWDAVVIGGGHNGLTAAAYLARGGLSVAVLERRHVIGGAAVTEEIVPGFKFSRCSYLQGLLRPCIIRELELGRHGLKLLKRSPSSFTPCLDGRYLLLGPDQDLNHSEISKFSKHDADAYPRYEKQLERFCGFMDPLLDSTPPESLQSASSFNDKLSNKMYKSAFWARCLRQAVSLGHKDMVAFMDLLLAPASKVLNNWFESDVLKASLATDAVIGSTASVHTPGSGYVLLHHVMGETDGEKGIWSYVEGGMGSVSMAIANAAKEAGAEIFTNAEVSEILTEDSSIVKGVLLADGTRVESSAILSNATPYRTYVELVPTNVLPENFVSAIKNSDYSSATTKINLAVDKLPQFQCCNTNHSGPGPEHFGTIHIGAESMDEVHSACHDSENGLPSRRPVIEMTIPSTLDNTISPPGKHVINLFIQYTPYKPSDGSWEDPTYREAFAQRCFKLIDEYAPGFSSSIISYDMLTPPDLEREIGLTGGNIFHGAMGLDSLFLMRPVKGWSNYRSPLKGLYLCGSGAHPGGGVMGAPGRNAAHVVLQDLKRI

SEQ ID NO: 812 - protein, 726 aa, Arabidopsis thaliana
MILRTPQPKRLRSDAGESPFPTGATGSGNQLIIYEDSPLPAPAPLQTSHDHSADQHLCTYQCRQMVKADVLDALSTAEKQVEESKTKLQTLNANFTEADAERKHFRDKFLYSEQELAAAKAREKMLQEQLLMEINNSQERYTKELQSCHELEVKLQNEMNLRKKAESSAATAEEKAKLLEDKLTQLSGSVDREKKRLNNDIAQLGKEAKLSVARIGADLERMQCRAQNAETESNLLRSQLEHLKLIFDECLQEKTEVDKKLSSFTSEAASSSDNSVLVKHLQEELKRYEAEVREARKLKSRHLDAELLNVNLLEEQSRRERAESELSKFHDLQLSMEKLENELSSWKSLLNDIPGVSCPDDIVMRFSVLQNEVVQSTMKIGEASTRIKQLEETLEAIQLGRQNAVSEAALAKEKSEALKTDVKRIEVMLTLVTEEKEQLKAVVNELRKSNSEGSVSGAADGALIQGFESSLAKKENYIKDLEQDLNQLKDVNNRQRTEIELLNEKLVDEARRNKSLERDSDRLRSEISLLESKLGHGDYSAANTRVLRMVNTLGVENEAKQTIEALQAELQKTKERLQAVEELKSQSGDAGKLVDSHITGKIAQLKEQNATLEKREERYKTVFADRISVFRRACCELFGYKIVMDEHQRPNGIPVTRFTLQSIYAQSDDEKLEFEYESGNTSILNNEYASQGDIAKQIEIFIRKFNSIPAFTANLTMESFNRRTLY

SEQ ID NO: 813 - protein, 723 aa, Arabidopsis thaliana
MSMASSSLATQSFFSSFPLSHRLHFPVPYLLLRSSFFRKPLSLSATSPSSSSSSPSIFLSCFDDALPDKIQQPENSTINSEESECEEEDDEEGDDFTDPILKFFKSRTLTSESTADPARESKFSLQKNRRTSWHLAPDFADPETEIESKPEESVFVTNQQTLGVHIPFESGVAREILELAKNLKENQTLGEMLSGFERRVSDTECVEALVMMGESGFVKSCLYFYEWMSLQEPSLASPRACSVLFTLLGRERMADYILLLLSNLPDKEEFRDVRLYNAAISGLSASQRYDDAWEVYEAMDKINVYPDNVTCAILITTLRKAGRSAKEVWEIFEKMSEKGVKWSQDVFGGLVKSFCDEGLKEEALVIQTEMEKKGIRSNTIVYNTLMDAYNKSNHIEEVEGLFTEMRDKGLKPSAATYNILMDAYARRMQPDIVETLLREMEDLGLEPNVKSYTCLISAYGRTKKMSDMAADAFLRMKKVGLKPSSHSYTALIHAYSVSGWHEKAYASFEEMCKEGIKPSVETYTSVLDAFRRSGDTGKLMEIWKLMLREKIKGTRITYNTLLDGFAKQGLYIEARDVVSEFSKMGLQPSVMTYNMLMNAYARGGQDAKLPQLLKEMAALNLKPDSITYSTMIYAFVRVRDFKRAFFYHKMMVKSGQVPDPRSYEKLRAILEDKAKTKNRKDKTAILGIINSKFGRVKAKTKGKKDEFWKYKTNRTTSPGRHRS

SEQ ID NO: 814 - protein, 234 aa, Arabidopsis thaliana
MAAGLSTIAVTLKPLNRSSFSANHPISTAVFPPSLRFNGFRRRKILTVCFVVEERKQSSPMDDDNKPESTTSSSEILMTSRLLKKAEKKKSERFTYLIAAVMSSFGITSMAIMAVYYRFSWQMKGGEVSVLEMFGTFALSVGAAGLGITMFGMAYMFVHDGLVHKRFPVGPIANVPYLRKVAAAHQLHHTDKFKGVPYGLFLGPKEVEEVGGKEELEKEISRRIKLYNKGSSTS

SEQ ID NO: 815 - protein, 375 aa, Arabidopsis thaliana
MSSETSSLTKKMKKKKEGLGWIESIKGWSCVFHEFLFQRFMASHLQNPLPLPSLNHLTCIVTGSTSGIGRETARQLAEAGARVVMAVRNTKAAHELIQQWQKEWSGKGIPLNLEAMELDLLSLDSVVGFCNLWNARLSPLHVLINNAGIFSMGEEQKFSKDGYEQHMQVNHLAPALLSLLLLPSLIRGSPSRIINVNSVMHYVGFVDPDDMNVVSGKRKFTSLVGYSGSKLAQVMFSNVLLKRLPLETRISVVCLSPGIVLTNVARDLPRYVQVQYALIPYFIFSPQEGSRSTLFSATDAQIPEHCEKLKTEDKPVCTFISQNCKHTKPSEEAHNVETAERVWEKTIKLIGLPLDAVERLIEGEEVQCRYGTHQQ

SEQ ID NO: 816 - protein, 365 aa, Arabidopsis thaliana
MDFLKVSDKTTIPYRSDSLFSLNQQQYKESSFGFRDMEIHPHPTPYAGNGLLGCYYYYPFTNAQLKELERQAMIYKYMIASIPVPFDLLVSSPSSASPCNNKNIAGDLEPGRCRRTDGKKWRCAKEVVSNHKYCEKHLHRGRPRSRKHVEPPYSRPNNNGGSVKNRDLKKLPQKLSSSSIKDKTLEPMEVSSSISNYRDSRGSEKFTVLATTEQENKYLNFIDVWSDGVRSSEKQSTTSTPVSSSNGNLSLYSLDLSMGGNNLMGQDEMGLIQMGLGVIGSGSEDHHGYGPYGVTSSLEEMSSWLAPMSTTPGGPLAEILRPSTNLAISGDIESYSLMETPTPSSSPSRVMKKMTSSVSDESSQV

SEQ ID NO: 817 - protein, 524 aa, Arabidopsis thaliana
MECVGARNFAAMAVSTFPSWSCRRKFPVVKRYSYRNIRFGLCSVRASGGGSSGSESCVAVREDFADEEDFVKAGGSEILFVQMQQNKDMDEQSKLVDKLPPISIGDGALDLVVIGCGPAGLALAAESAKLGLKVGLIGPDLPFTNNYGVWEDEFNDLGLQKCIEHVWRETIVYLDDDKPITIGRAYGRVSRRLLHEELLRRCVESGVSYLSSKVDSITEASDGLRLVACDDNNVIPCRLATVASGAASGKLLQYEVGGPRVCVQTAYGVEVEVENSPYDPDQMVFMDYRDYTNEKVRSLEAEYPTFLYAMPMTKSRLFFEETCLASKDVMPFDLLKTKLMLRLDTLGIRILKTYEEEWSYIPVGGSLPNTEQKNLAFGAAASMVHPATGYSVVRSLSEAPKYASVIAEILREETTKQINSNISRQAWDTLWPPERKRQRAFFLFGLALIVQFDTEGIRSFFRTFFRLPKWMWQGFLGSTLTSGDLVLFALYMFVISPNNLRKGLINHLISDPTGATMIKTYLKV

SEQ ID NO: 818 - protein, 383 aa, Arabidopsis thaliana
MDEVSPAVAVPFRPFTDPHAGLRGYCNGVDISAGDEINGSDEFDPRSMNQSEKKVLSRTESRSLFEFKCVPLYGVTSICGRRPEMEDSVSTIPRFLQVSSSSLLDGRVTNGFNPHLSAHFFGVYDGHGGSQVANYCRERMHLALTEEIVKEKPEFCDGDTWQEKWKKALFNSFMRVDSEIETVAHAPETVGSTSVVAVVFPTHIFVANCGDSRAVLCRGKTPLALSVDHKPDRDDEAARIEAAGGKVIRWNGARVFGVLAMSRSIGDRYLKPSVIPDPEVTSVRRVKEDDCLILASDGLWDVMTNEEVCDLARKRILLWHKKNAMAGEALLPAEKRGEGKDPAAMSAAEYLSKMALQKGSKDNISVVVVDLKGIRKFKSKSLN

SEQ ID NO: 819 - protein, 255 aa, Arabidopsis thaliana
MTVGVLALQGSFNEHIAALRRLGVQGVEIRKADQLLTVSSLIIPGGESTTMAKLAEYHNLFPALREFVKMGKPVWGTCAGLIFLADRAVGQKEGGQELVGGLDCTVHRNFFGSQIQSFEADILVPQLTSQEGGPETYRGVFIRAPAVLDVGPDVEVLADYPVPSNKVLYSSSTVQIQEEDALPETKVIVAVKQGNLLATAFHPELTADTRWHSYFIKMTKEIEQGASSSSSKTIVSVGETSAGPEPAKPDLPIFQ

SEQ ID NO: 820 - protein, 406 aa, Arabidopsis thaliana
MAALTLHHHHHHRHHSCLQASGHLSRRLYHRIFSSFPRNPVKDLNFRLSLADFSSFSLSTRGTVFAVRALSTVAVEESSEKKMVKGIRVYEHGGPEVLKWEDVEVGEPKEGEIRVKNKAIGLNFIDVYFRKGVYKPASMPFTPGMEAVGEVVAVGSGLTGRMIGDLVAYAGNPMGAYAEEQILPADKVVPVPSSIDPIVAASIMLKGMTAQFLLRRCFKVEPGHTILVHAAAGGVGSLLCQWANALGATVIGTVSTNEKAAQAKEDGCHHVIMYKNEDFVSRVNDITSGKGVNVVYDSVGKDTFKGSLACLKSRGYMVSFGQSSGSPDPIPLSDLAPKSLFLTRPSMMHYNETRDELLECAGEVFANVTSGILKARVNHKYPLSRVADAHADLENRITSGSVVLLP

SEQ ID NO: 821 - protein, 298 aa, Arabidopsis thaliana; identical to SEQ ID NO: 131

SEQ ID NO: 822 - protein, 345 aa, Arabidopsis thaliana
MVLVTHKLQGSHVLSPWSSPTWTRGLCLKRPVTTVHFVERKDKHLRLKQKCCFSLGSPCNGGLRAKPFRVTSFKGGIQNNESGGSEGGKKVTNNSVKLSYRSDDDENNVNGSPKAQNTSFSYTSETEDSMTGQPAIQKLFKKWLTLLRTQSPIQVIDETLGGEQVPQTTKQETETEIRKAESLQSTKNTVWSWFWSLDAAIKIPLLLFVPAFLAVYAICGAEVTKELSPMWVVGPLIIALYIKMFQGLCSLYAFCFNQTIKMIRNLPSYYLVAYQYIADGKLKDDVKALVFKPVVAIKNTDYKELTRTKLKQFQEWIIEKYLDFVESVWPYYCRTIRFLKRANLI

SEQ ID NO: 823 - protein, 312 aa, Arabidopsis thaliana
MDFALFSSISIFEINHKDPPIRRFIKTQNRILSTRKQQGTFPKMKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 824 - protein, 570 aa, Arabidopsis thaliana
MASLVYGTPWLRVRSLPELAPAFLRRRQSSLFYCSRRSFAVVACSTPVNNGGSVRVRFAPSPTGNLHVGGARTALFNYLFARSKGGKFVLRIEDTDLERSTRESEAAVLQDLSWLGLDWDEGPGVSGDFGPYRQSERNALYKQYAEKLLESGHVYRCFCSSEELVKMKENAKLKQLPPVYTGKWATASDAEIEQELEKGTPFTYRFRVPKEGSLKINDLIRGEVCWNLDTLGDFVVMRSNGQPVYNFCVTVDDATMAISHVIRAEEHLPNTLRQALIYKALKFPMPQFAHVSLILAPDRSKLSKRHGATSVGQYREMGYLPQGMVNYLALLGWGDGTENEFFTLEDLVEKFSIERVNKSGAIFDSTKLRWMNGQHLRALPNEKLTKLVGERWKSAGILTESEGSFVNEAVELLKDGIELVTDSDKVLLNLLSYPLHATLASPEAKPAVEDKLHEVAASLIAAYDSGEIPSALEEGQGAWQKWVKAFGKSLKRKGKSLFMPLRVLLTGKLHGPEMGTSIVLIYKAGSPGIVVPQAGFVSMEERFKILREIDWEALNKDESVPLESTATVST

SEQ ID NO: 825 - protein, 295 aa, Arabidopsis thaliana
MGDDEARSWIRGDETAKQMLSRVLKDRAFLLIPPLHRVPLRAGNVVEITGASTSAKTQILIQAAISCILPKTWNGIHYGGLGKLVLFLDLDCRFDVLRLSQMLKHRLLQANWLGNGAWWQLEESNVKSCKSAEEKTKTVFDEELYASCMKRFLYVRCYDSLELLSSLKYFTVLQTLHYRIQQQEACGSQVGVLMIDSIGAFHWTDRLSSSLALETHNRKSLSLTNVVETIVQELKKLLLVHSLVVLATKGTIYEEKYPANENNRSPQTTIFQGMLQVKLSNLHFVNSCLLLGRHL

SEQ ID NO: 826 - protein, 185 aa, Arabidopsis thaliana
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSVDSLISMEEQLETALSVIRAKKTELMMEDMKSLQEREKLLIEENQILASQVGKKTFLVIEGDRGMSRENGSGNKVPETLSLLK

SEQ ID NO: 827 - protein, 231 aa, Arabidopsis thaliana
MGRRKVEIKRIENKSSRQVTFCKRRNGLMEKARQLSILCESSVALIIISATGRLYSFSSGDSMAKILSRYELEQADDLKTLCLNIVERDQHRITLFFTVGIALESPRRGSKLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 828 - protein, 197 aa, Arabidopsis thaliana
MGRRRVEIKRIENKSSRQVTFCKRRNGLMEKARQLSILCGSSVALFIVSSTGKLYNSSSGDRVVYVSWKRKNFTIFLSWQDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 829 - protein, 1259 aa, Arabidopsis thaliana
MEGQRGSNSSLSSGNGTEVATDVSSCFYVPNPSGTDFDAESSSLPPLSPAPQVALSIPAELAAAIPLIDRFQVEAFLRLMQKQIQSAGKRGFFYSKKSSGSNVRERFTFEDMLCFQKDPIPTSLLKINSDLVSRATKLFHLILKYMGVDSSDRSTPPSLDERIDLVGKLFKKTLKRVELRDELFAQISKQTRHNPDRQYLIKAWELMYLCASSMPPSKDIGGYLSEYIHNVAHDATIEPDAQVLAVNTLKALKRSIKAGPRHTTPGREEIEALLTGRKLTTIVFFLDETFEEISYDMATTVSDAVELAGTIKLSAFSSFSLFECRKVVSSSKSSDPGNEEYIGLDDNKYIGDLLAEFKAIKDRNKGEILHCKLVFKKKLFRESDEAVTDLMFVQLSYVQLQHDYLLGNYPVGRDDAAQLCALQILVGIGFVNSPESCIDWTSLLERFLPRQIAITRAKREWELDILARYRSMENVTKDDARQQFLRILKALPYGNSVFFSVRKIDDPIGLLPGRIILGINKRGVHFFRPVPKEYLHSAELRDIMQFGSSNTAVFFKMRVAGVLHIFQFETKQGEEICVALQTHINDVMLRRYSKARSAANSLVNGDISCSSKPQNFEVYEKRLQDLSKAYEESQKKIEKLMDEQQEKNQQEVTLREELEAIHNGLELERRKLLEVTLDRDKLRSLCDEKGTTIQSLMSELRGMEARLAKSGNTKSSKETKSELAEMNNQILYKIQKELEVRNKELHVAVDNSKRLLSENKILEQNLNIEKKKKEEVEIHQKRYEQEKKVLKLRVSELENKLEVLAQDLDSAESTIESKNSDMLLLQNNLKELEELREMKEDIDRKNEQTAAILKMQGAQLAELEILYKEEQVLRKRYYNTIEDMKGKIRVYCRIRPLNEKESSEREKQMLTTVDEFTVEHPWKDDKRKQHIYDRVFDMRASQDDIFEDTKYLVQSAVDGYNVCIFAYGQTGSGKTFTIYGHESNPGLTPRATKELFNILKRDSKRFSFSLKAYMVELYQDTLVDLLLPKSARRLKLEIKKDSKGMVFVENVTTIPISTLEELRMILERGSERRHVSGTNMNEESSRSHLILSVVIESIDLQTQSAARGKLSFVDLAGSERVKKSGSAGCQLKEAQSINKSLSALGDVIGALSSGNQHIPYRNHKLTMLMSDSLGGNAKTLMFVNVSPAESNLDETYNSLLYASRVRTIVNDPSKHISSKEMVRLKKLVAYWKEQAGKKGEEEDLVDIEEDRTRKDEADS

SEQ ID NO: 830 - protein, 359 aa, Arabidopsis thaliana
MQSLSTPHTISLLLPRTSPSRLSPSLHSLAFPTRLRSLSYSSQTSILPDAGDDFIVGDCLVYEDGVFEDPYLDKEVTQVAKQERKKNRRGGAKRLDESEIEPENLVPEEWRDIQAEVNLTKKDKRKIAQEMEFGVRVEKKRQGLIPLRKVDLNDFLTYKEAKLAQLRPVILDKPGNFSDDSGASSDGETAVSSPSERVAPKNPRWAVYGKGFDHVAKFFNSDKYDPSDKKSDGPRKLLSKEEKFMLNSRNPDLAVATSKKWLPLHTLAACGEFYLVDSLLKHNLDINATDVGGLTVLHRAIIGKKQAITNYLLRESANPFVLDDEGATLMHYAVQTASAPTIKLLLLYNADINAQDRVG

SEQ ID NO: 831 - protein, 332 aa, Arabidopsis thaliana
MAASLQSTATFLQSAKIATAPSRGSSHLRSTQAVGKSFGLETSSARLTCSFQSDFKDFTGKCSDAVKIAGFALATSALVVSGASAEGAPKRLTYDEIQSKTYMEVKGTGTANQCPTIDGGSETFSFKPGKYAGKKFCFEPTSFTVKADSVSKNAPPEFQNTKLMTRLTYTLDEIEGPFEVASDGSVNFKEEDGIDYAAVTVQLPGGERVPFLFTVKQLDASGKPDSFTGKFLVPSYRGSSFLDPKGRGGSTGYDNAVALPAGGRGDEEELVKENVKNTAASVGEITLKVTKSKPETGEVIGVFESLQPSDTDLGAKVPKDVKIQGVWYGQLE

SEQ ID NO: 832 - protein, 610 aa, Arabidopsis thaliana
MGSTPFCYSINPSPSKLDFTRTHVFSPVSKQFYLDLSSFSGKPGGVSGFRSRRALLGVKAATALVEKEEKREAVTEKKKKSRVLVAGGGIGGLVFALAAKKKGFDVLVFEKDLSAIRGEGKYRGPIQIQSNALAALEAIDIEVAEQVMEAGCITGDRINGLVDGISGTWYVKFDTFTPAASRGLPVTRVISRMTLQQILARAVGEDVIRNESNVVDFEDSGDKVTVVLENGQRYEGDLLVGADGIWSKVRNNLFGRSEATYSGYTCYTGIADFIPADIESVGYRVFLGHKQYFVSSDVGGGKMQWYAFHEEPAGGADAPNGMKKRLFEIFDGWCDNVLDLLHATEEEAILRRDIYDRSPGFTWGKGRVTLLGDSIHAMQPNMGQGGCMAIEDSFQLALELDEAWKQSVETTTPVDVVSSLKRYEESRRLRVAIIHAMARMAAIMASTYKAYLGVGLGPLSFLTKFRVPHPGRVGGRFFVDIAMPSMLDWVLGGNSEKLQGRPPSCRLTDKADDRLREWFEDDDALERTIKGEWYLIPHGDDCCVSETLCLTKDEDQPCIVGSEPDQDFPGMRIVIPSSQVYKLYACSCDLQRRSFLLDGSSKRTRNLCDR

SEQ ID NO: 833 - protein, 352 aa, Arabidopsis thaliana; identical to SEQ ID NO: 147

SEQ ID NO: 834 - protein, 367 aa, Arabidopsis thaliana
MALEKEEEASQNGAFCVLDGLYCEEETGFVEDDLDDDGDLDFLEKSDESVVKFQFLPLLDMFLWDDDEILSLISKENETNPCFGEQILDGFLVSCRKEALDWVLRVKSHYGFTSLTAILAVNYFDRFMTSIKLQTDKPWMSQLVAVASLSLAAKVEEIQVPLLLDLQVEEARYLFEAKTIQRMELLILSTLQWRMHPVTPISFFDHIIRRFGSKWHQQLDFCRKCERLLISVIADTRFMRYFPSVLATAIMILVFEELKPCDEVEYQSQITTLLKVNQEKVNECYELLLEHNPSKKRMMNLVDQDSPSGVLDFDDSSNSSWNVSTTASVSSSSSSPEPLLKRRRVQEQQMRLPSINRMFLDVLSSPR

SEQ ID NO: 835 - protein, 611 aa, Arabidopsis thaliana
MDASVVRFSQSPARVPPEFEPDMEKIKRRLLKYGVDPTPKILNNLRKKEIQKHNRRTKRETESEAEVYTEAQKQSMEEEARFQTLRREYKQFTRSISGKRGGDVGLMVGNPWEGIERVKLKELVSGVRREEVSAGELKKENLKELKKILEKDLRWVLDDDVDVEEFDLDKEFDPAKRWRNEGEAVRVLVDRLSGREINEKHWKFVRMMNQSGLQFTEDQMLKIVDRLGRKQSWKQASAVVHWVYSDKKRKHLRSRFVYTKLLSVLGFARRPQEALQIFNQMLGDRQLYPDMAAYHCIAVTLGQAGLLKELLKVIERMRQKPTKLTKNLRQKNWDPVLEPDLVVYNAILNACVPTLQWKAVSWVFVELRKNGLRPNGATYGLAMEVMLESGKFDRVHDFFRKMKSSGEAPKAITYKVLVRALWREGKIEEAVEAVRDMEQKGVIGTGSVYYELACCLCNNGRWCDAMLEVGRMKRLENCRPLEITFTGLIAASLNGGHVDDCMAIFQYMKDKCDPNIGTANMMLKVYGRNDMFSEAKELFEEIVSRKETHLVPNEYTYSFMLEASARSLQWEYFEHVYQTMVLSGYQMDQTKHASMLIEASRAGKVTNLCLV

SEQ ID NO: 836 - DNA, 3738 bp, Arabidopsis thaliana
tgggcatacgtattcggggtggtcccattcatcgtcgtcgtctgtgttagggagcacaaataatagagaggcgtagcacaagagagaaggtggtgatcgaggccaagatttagaatttaactataacaaaaagcctctgacgagtgtgactagtcacaagatctgatcatggcttcttgaaacttcttcttcttctttcttctctttaaaggaaaaaaatgtcaggctctaggccgactcagtcctctgagggctcaaggcgatcaaggcacagcgctaggatcattgcgcagaccactgtagatgcgaaactccatgctgattttgaggagtcaggcagctcctttgattactcaacctcagtgcgtgtcactggcccggttgtggagaatcagccaccaagaccttcaaagttattgcatacagcgagaatgcatctgagctgttgacaatggccagtcatgcagttcctagtgttggcgaacaccctgttctaggcattgggacagatataaggagtcttttcactgctcctagtgcgtctgcattgcagaaagcccttggatttggagatgtctctcttttgaatcccattcttgtgcactgcaggacttctgcaaagcccttttatgcgattatccacagggttacagggagcatcatcatcgactttgaacccgtgaagccttatgaagtccccatgacagctgctggtgccttacaatcatacaagctcgctgccaaagcaatcactaggctgcaatctttacccagcgggagtatggaaaggctttgtgatacaatggttcaagaggtttttgaactcacggggtatgacagggtgatggcttataagtttcatgaagatgatcacggtgaggttgtctccgaggttacaaaacctgggctggagccttatcttgggctgcattatcctgccaccgacatccctcaagcagcccgttttctgtttatgaagaacaaggtccggatgatagttgattgcaatgcaaaacatgctagggtgcttcaagatgaaaagctttcctttgaccttaccttgtgtggctccacccttagagcaccgcacagctgccatttgcagtacatggccaacatggattcaattgcatctctggttatggcggttgtagttaacgaggaagatggagaaggggatgctcctgatgctactacacagcctcaaaagagaaagagactatggggtttagtggtttgtcacaatacgactccgaggtttgttccatttcctctcaggtatgcctgtgagtttctagctcaagtgtttgccatacacgtcaataaggaggtggaactcgataaccagatggtggagaagaacattttgcgcacgcagacactcttgtgcgatatgctgatgcgtgatgctccactgggtattgtgtcgcaaagccccaacataatggaccttgtgaaatgtgatggagcagctctcttgtataaagacaagatatggaaactgggaacaactccaagtgagttccacctgcaggagatagcttcatggttgtgtgaataccacatggattcaacgggtttgagcactgatagtttgcatgacgccgggtttcctagggctctatctctcggggattcggtatgtgggatggcagctgtgaggatatcatcgaaagacatgattttctggttccgttctcataccgctggtgaagtgagatggggaggtgcgaagcatgatccagatgatagggatgatgcaaggagaatgcacccaaggtcatcgttcaaggctttccttgaagtggtcaagacaaggagtttaccttggaaggactatgagatggatgccatacactccttgcaacttattttgaggaatgctttcaaggatagtgaaactactgatgtgaatacaaaggtcatttactcgaagctaaatgatctcaaaattgatggtatacaagaactagaagctgtgaccagtgagatggttcgtttaattgagactgctacggtgccaatattggcggttgattctgatggactggttaatggttggaacacgaaaattgctgagctgactggtctttcggttgatgaagcaatcgggaagcatttcctcacacttgttgaagattcttcagtggaaatcgttaaaaggatgctagagaacgcattagaaggaactgaggagcagaatgtccagtttgagatcaagacacatctgtccagggctgatgctgggccaataagtttagttgtaaatgcatgcgcaagtagagatctccatgaaaacgtggttggggtgtgttttgtagcccatgatcttactggccagaagactgtgatggacaagtttacgcggattgaaggtgattacaaggcaatcatccaaaatccaaacccgctgatcccgccaatatttggtaccgatgagtttggatggtgcacagagtggaatccagcaatgtcaaagttaaccggtttgaagcgagaggaagtgattgacaaaatgctcttaggagaagtatttgggacgcagaagtcatgttgtcgtctaaagaatcaagaagcctttgtaaaccttgggattgtgctgaacaatgctgtgaccagtcaagatccagagaaagtatcgtttgctttctttacaagaggtggcaagtatgtggagtgtctgttgtgtgtgagtaagaaactggacagggaaggtgtagtgacaggtgtcttctgtttcctgcaacttgccagccatgagctgcagcaagcgctccatgttcaacgtttagctgagcgaaccgcagtgaagagactaaaggctctagcatacataaaaagacagatcaggaatccgctatctgggatcatgtttacaaggaaaatgatagagggtactgaattaggaccagagcaaagacggattttgcaaactagcgcgttatgtcagaagcaactaagcaagatcctcgatgattcggatcttgaaagcatcattgaaggatgcttggatttggaaatgaaagaattcaccttaaatgaagtgttgactgcttccacaagtcaagtaatgatgaagagtaacggaaagagtgttcggataacaaatgagaccggagaagaagtaatgtctgacactttgtatggagacagtattaggcttcaacaagtcttggcagatttcatgctgatggctgtaaactttacaccatccggaggtcagctaactgtttcagcttccctgaggaaggatcagctcgggcgttctgtgcatcttgctaatctagagatcaggttaacgcataccggagctgggatacctgagtttttactaaaccaaatgtttgggactgaggaagatgtgtcagaagaaggattgagcttaatggttagccggaaactggtgaagctgatgaatggagatgttcagtacttgagacaagctgggaaatcaagtttcattatcactgcggaactcgctgcagcaaacaagtagtccccaaaagaaaaggggtctggcttgatataaaatagtcactggttgttctttgcttgtaactttccttatcgcttttgttttcgttttcaaatttcagtaacgatgaaatatccatccatttacatcttctgttgaactcttttctgaagctgtaaatatggatgcatatctaatctcctcctgagtgttttggtttcatgatgtatcattcaaaataagtaatataggagaaatgagct

SEQ ID NO: 837 - DNA, 1491 bp, Arabidopsis thaliana
aggcagagagaagaagatttgattgaagtacagatccatcggagaagaagacagagagattgaagatcaatgacttcgagatattgggtggtgtctcttccagtgaaagactctgcttcttcgttatggaatcgattacaagagcagatctctaagcattcctttgatactccagtttatcggtttaacattcctaatcttcgtgttggaaccttagattctctactcgctctcggcgatgatctgcttaagtcgaacagctttgtggaaggagtttcgcaaaagatcaggagacagatcgaagaattggagaggatttctggtgttgagagcaacgctcttacagttgatggagttcctgttgattcttatctcaccaggtttgtgtgggatgaagctaagtacccaacaatgtcacctctgaaggaggttgtggacaatattcagtctcaggttgcaaaaattgaggatgatctcaaggttcgtgttgctgaatataacaatatccgtggtcaactcaatgccattaaccgaaagcaaagtggaagcttagctgttcgtgacctctcaaacttggttaagccagaagatattgtcgagtccgaacatctcgtaactctccttgcagttgttccgaagtattcccaaaaagactggctagcatgttatgagactttgaccgattatgtggttcctaggtcctcgaagaaattgtttgaggataatgagtatgccctttacaccgtcactctctttactcgtgtcgcagataatttcaggattgctgctcgtgagaaaggattccaagtccgtgattttgaacaaagtgttgaagcacaagagactcgtaaacaagagctagcaaagttggttcaggatcaggaaagtttgagaagctctcttttgcagtggtgctacaccagttatggagaggttttcagctcctggatgcatttctgtgctgtgcgtacattcgctgagagcattatgagatacggtttacctccggcgttcttggcatgtgtcttatctccggctgtgaaaagtgaaaagaaagtacgctccattcttgaacgcttgtgtgattctaccaacagtttatactggaaaagcgaggaggatgcaggagccatggctggtttagctggtgactcagagacacatccttatgtctccttcactatcaaccttgcttaaaaatatgatgagagatgcttttgatgccacttctcctctggtcttctcatctgttatatttgtttgtggtctatagatttcacatttatttttcgtaacatattttgattttcataaataaggtggaactcaagagagatgttgctgtaattttatttggccggagtcttttagattccggcgagtttcagacacttgtggaagacagaagggttatacagttgttaaagcctttttgtcattttgtgacatggttgatttatttatatcatcactctgtttcgtttttgtctg

SEQ ID NO: 838 - DNA, 1915 bp, Arabidopsis thaliana
atcggaaaaatctcacacgataaagtaccagtcgacgacggcgactttctctatgatctgaccgtttcgctgaatctcacgtgaatctctgattttccgggaaaatcaattttctctcattgtctctctccctacattgtttctcatagcctacgagaaattacgtggtagcttgtcggaaactcaacttccgttgacggaaggcgcgagaaagaagcaagcttaggttcgatcggaaaattctagggttctctagtgtttaaacggtagagataatcgatctctaatcggatactgttttggatctccattcacaccctctggtgagctgattttgctttagagatcgccggcttagtttctctaatggatccgacttctcgacccgctattgtcatcgacaatggaactgggtatactaaaatgggatttgcgggtaatgtagagccatgttttatcttaccaacagtagttgcagtaaacgagtcgtttttgaatcaatccaagagttcttctaaggcaacttggcaaactcagcacaacgctggagttgctgcggatctcgatttctatattggagatgaagctcttgcgaaatcgcggtctagtagtactcataatcttcattatccaattgagcatggtcaagttgaggattgggatgctatggagagatattggcagcagtgtatatttaactatttgagatgtgatcctgaggatcattattttcttcttactgaaagtcctcttactcctcctgaaagtcgagaatatactggagaaattttgtttgagacttttaatgttcctgggctttacattgctgttaattcagttcttgcacttgctgctggctacacaacatcaaagtgtgagatgacaggggttgtagtagatgttggagatggggcaactcatgttgtacctgttgcagaaggttatgtcatcgggagctgtatcaaatcgattccaattgctggcaaagatgtcaccctctttatccagcaactcatgcgggaaagaggtgagaatataccaccagaagattcattcgatgtagcccgtaaagtgaaggaaatgtactgctacacttgttctgacatcgtaaaggagtttaataaacatgacaaagaaccagcaaagtatattaaacaatggaaaggtgtaaagccaaagactggtgcaccatacacttgcgacgtgggatatgaacgattccttggacccgaggtgttctttaatccagagatatacagcaatgacttcacaactactttaccagctgtgatagacaaatgtattcagtctgcaccaattgacacacgaagagctttatataagaatatagtgttgtccggaggttcaactatgttcaaagatttcggaagaaggttacaaagggacctcaagaagattgttgatgctcgtgttcttgctaataacgctcgtactggtggtgaaattacgtctcaaccggtggaggttaatgtcgtgagccatcctgtccagaggtttgcagtttggtttggaggctctgtgctttcatcaactcctgagtttttcgcgagttgcagaacgaaagaggagtatgaggaatatggagcaagcatatgccgcacgaatccggtgttcaagggaatgtattgaagctgcttcataaataattcaccagcagattctgtgaatgtttgtctgctttactccatttctattactgactttagggttcttgagtacacacagtgtaagctaggcttgatgtagaagtcatattattattcagacaaattaaagaaaaaaagtatgtagaagtttgatttttttttcatattattttctgttaactcaagcattaaattccacagaaaagttccggattatcaatcgtctaattgtcaagttatcatttttt

SEQ ID NO: 839 - DNA, 4835 bp, Arabidopsis thaliana
ccctcctcgagaatttccgatcgtgctttcctcaaaagcatttctgtttctcgtcgtcggagcccgacgacagatctctgaatcgctggagaaacataatgattgagtttggcctctatctgtgaagggtatatgctccggctgtatctactttatattctgccaggaagattgtgagcattgaagtgccttgggctctggctgaagatttgagcagattaaatgggtcgcctaaagttgcattctggaatcaaggccattgaggaagaacctgaggactttgagtgtactgattcaagtaatacaaccactttagcatgcatgattgatacggaaattgctgctgttttagcggttatgagaagaaatgtaagatggggaggtcgatacatgtctggtgatgatcaactagaacactcgttgattcagtcacttaaagctcttagaaaacaggtgttctcatggaaccagccgtggcatacaattagtcccatgttgtatcttcagccctttcttgatgtgatacggtcagatgaaactggagcaccaataaccagcattgctttgtcatcagtttacaagatcttaaacctgaatgtaattgatcaaaatactgcgaatattgaagacgctatgcacttggtagttgattctgtgacaagctgtcgatttgaggtgacagatcctgcatcagaagaggttgtgctaatgaagatacttcaggttcttctagcatgtatgaaaaataaagcatcagttatgctaagcaatcagcatgtatgcactgtcgtcaacacttgttttcgtgttgtccaccaagcaggaatgaaaggtgagttattgcaacgagtagctcgccacacgatgcatgaattagtgaggtgtatcttctcgcatctcccagatgttgaaagaacagaaactacacttgtcaacagagctggtagcatcaaacaagagaaagctggagtagacagtgattatgccattgtgagtaaaccagtcgaggatggaaatgctaattccgagtatgatgttgaaaattctatggcaacttttgcaactggtgctcaaagtttgatggatgatggaccagttggccctggaagcagaaagccggcttctccatatgatttgcatataatgacagagccatacggagtcccaagtatggtggaaatttttcacttcttgtgctctttgttaaatgtggtcgaacatgttggtatgggatcccgatcaaacaccatagcatttgacgaagatgtgcctctgtttgcgttgaacttgatcaactcagccattgaattgggtggatcgtccatccgccatcacccaagattgttaagcctaattcaagatgagttatttcgtaacttgatgcagttcggattgtcgatgagccccctgattctttcgatggtttgcagcattgtgctcaatttgtatcaacatctacgaactgaactcaagttgcagcttgaggcattcttttcatgtgtgattctaaggcttgctcaaggaaaatatgggccctcgtatcagcagcaagaggttgctatggaggctcttgtgaatttttgtaggcagaagagttttatggttgaaatgtatgccaatctcgattgtgatataacttgcagcaacgtgtttgaggagctgtctaatcttctctcgaagagcacatttcctgtgaactgtcctttgtctgcaatgcacattcttgctctggatggcctaatcgctgttattcagggaatggccgagaggataagtaatggattgactggtttggatttgggtcctgtccatcttgatgagtacacgcctttctggatggttaagtgtgacaactatagtgatccaaatcactgggtttcatttgtccgcaggagaaaatatatcaagagaaggttaatgattggagcagatcattttaacagggatccaaagaaggggttagagtttctccaaggcacacatcttttgcctgacaaactcgatccccaaagtgttgcttgcttttttagatatactgctgggcttgataagaaccttgttggggattttcttggaaatcatgacgaattttgtgttcaagttctcaatgagtttgctgggactttcgatttccagtacatgaatctggatactgcactccgactcttcttggaaaccttcaggttgcctggagaatcccagaaaatacagagagtgcttgaggcgttctctgaaagatactatatgcaatctcctgagattctggccaacaaggatgctgctcttgtgttatcatactctattatcatgcttaacactgatcagcacaacgttcaagtaaagaaaaagatgacagaagaggatttcattcgcaataataggcatatcaatggaggaaatgatctacctcgagaattcttgtctgaactctttcactccatctgcaacaatgagatcaggactactccagaacaaggtgcaggctttcctgaaatgactcccagccgttggattgatttgatgcataaatcaaagaaaactgctccatatattctggctgattcaagggcttatcttgaccatgatatgtttgctatcatgtctggtccaaccattgctgccatatcagtcgtttttgaccatgcagaacatgaagacgtttaccagacatgcatcgatggattcttggctatagctaaaatttctgcctgtcatcatcttgaagatgtgcttgatgatctggttgtctctctctgcaaattcacaactctgttgaatccatcatctgttgatgaacccgttcttgcatttggtgatgacgcaaaagcaaggatggctactatcacaatttttaccattgcaaacaaatatggagattatatacgtacgggttggaggaacatattggactgtatcttacggctacataaacttggacttctgccagctcgtgtagccagtgatgcagctgatgaatcagaacattcatctgagcaagggcaaggaaagcccctcgcgaattccctatcttcagctcatctacagtcaatgggaactccgaggagatcttccggattgatgggaagatttagtcagcttctttcacttgatacagaagagccaagatcacagcctactgagcaacagcttgcagctcatcaacgaacacttcaaacaattcagaaatgtcacattgacagcatatttaccgaaagcaagtttctacaagctgaatctttgttgcagcttgcgcgtgctctcatttgggctgcaggtaggccacagaaaggaaccagttctccagaggatgaggatactgcggttttctgtctggaattgcttattgcaatcactctaaacaacagagacaggatcgttctcctatggcaaggcgtctatgaacatatagctacaattgctcagtcaacggtgatgccctgcaacttagtggataaagctatttttggtctacttcggatctgccagagactacttccttataaagaaagcctagctgatgagcttttgagatctcttcagcttgtgctgaaactggatgcacgtgttgcagatgcctattgtgagcaaattgcaattgaagtcagccgtcttgtgaaagccaatgctaatcacatcaggtctcaggcgggttggagaacaatcacatccttactctccatcacagcgcggcacccagaagcttctgaatcaggatttgatgccgtatcctttgttatgtctgaaggaactcacctgtatccagccaattatgtactctgtgttgatgctgcaagacagtttgctgaatcccgcgtgggacagtccgaacgctctatccgtgcccttgatctaatgggagattcattagaatttttggctaaatgggctctctcagctaaggaaaacatgggagaagaagatttcgggaagatgtcacaagatattggggaaatgtggttaaggcttgttcaaggactaagaaaagtgtgtttagaccagagggaggatgtccgaaaccacgctttacagtcattacagaagtgtttaggcggagtagacggaatcaacctagctcatagcatgtggtctcaatgctttgacaaagtaatcttcacggttttggatgacttacttgagatagctgctgggtcacagaaagactaccgaaacatggaaggcacattgcttctcgcaatcaaacttctctccaaagtgtttcttcagcaactccaagagctatctcagttatcaaccttctgcaagctatggctcggtgttctaactcgaatggagaaatacatgaaagtgaaagtaagaggcaaaaaaagcgacaagctacaagaatcagtaccagagcttctcaaaaacatattgctggtgatgaagacgaaaggcgtgctattgcaaagaagtgctcttggtggagatagcttatgggagctaacatggcttcatgtgaataacattgcaccgtctatgcgactggagctattccctgatcaagaatcctcacaacttggtgatgatgaaaccgtatcgaatggcttatcttctcctgaaaacacaactggttcgtgaccttacaagtgagatcattaggtgagtttctttcgaatatccatataagtactgtgaaagtgaaagcttcttatgtaacacctctctacgtttttttttgtaatatataagtctttctaattcagagactcgtattaattaagcaagtttcttaattacgactttgttaatcacggacctttggaacgaggtagaaggtcttgaacatgtgtggaacccaccaaaggaaaaatatcagtagattcaggagagttgtt

SEQ ID NO: 840 - DNA, 1817 bp, Arabidopsis thaliana
tctctctataaacaagttttttatcacatttcttttctacagtattttctctattcacgcatatatatagatatccagctgcctccaacatatatagtcaactgatgaaattataagcatcatcattatagttttgtctcctttttttcttcttcttttctttttctttctagctactctcttcttcatagctagatcaagatgttagagatcattacggtaagaaaagtgttcttgatcggattcttgatcttgatactgaattgggtatggagagctgtgaattgggtttggttaaggccaaagagactggagaaatatctgaagaaacaaggattctctgggaattcttatagaattttaatgggagatatgagagagagtaatcagatggatcaagttgctcactctcttcctcttcctctcgacgccgattttctccctcgcatgatgccttttctccaccacactgttctaaaacatgggaagaagtgtttcacatggtacggaccgtacccgaacgtgatagtaatggatccagagacactccgagagattatgtcaaaacacgaactctttccaaaaccaaagatcgggtcacataatcatgttttcctaagtggtcttctcaatcacgaaggtcctaaatggtccaagcatcgaagcattcttaatcctgcttttcgtattgataatttgaagagcatactaccagcatttaactcgagttgcaaagaaatgttagaagaatgggagagattagcctcagcaaaaggaacaatggaacttgattcatggactcactgtcatgacttaaccagaaacatgcttgctcgtgcttcttttggtgattcctacaaagatggtatcaagatcttcgaaatccaacaagaacagattgatcttggtctccttgctattcgagccgtctacattcctggctcaaagtttttgccaacaaagttcaacaggaggttgagagaaaccgaaagggacatgagggctatgtttaaagcgatgattgagacaaaagaggaggagataaaaagaggaagagctggtcaaaatgtgacttcttcattgtttgtttggacacttgttgctctaagccaacatcaagattggcaaaacaaagcaagagacgagatttctcaggccttcggtaacaacgaacccgatttcgaagggctaagccacctgaaagtcgtaacaatgatcctccatgaagttctacgactctattcaccagcttacttcacatgtcggataactaaacaagaagtgaagctagagagattctctttacctgaaggagttgtagtaacaataccaatgctcttggtgcaccatgattctgatctttggggagacgatgtgaaagagtttaagcccgagagattcgccaatggcgtggcgggtgcaaccaaaggaagactctccttcttgccatttagctcgggccctcggacttgtatcggtcagaacttttcgatgttgcaagctaaactcttcttggcaatggtacttcaaaggttcagtgttgaactctctccatcgtatactcatgctcctttcccagctgcaactacatttccacaacatggagctcatttgatcatccgaaaactgtaggaggtagaagaatgaggaaaaaaatgtaaaggtgcttcctttttttttgttcatcaacaaaacagaaccttgaaggtgtgtagtggtaaatgcagtttgaatccggtcaagaaatcttatttgggtgtttttgtatatatgaaacaaattaaaatctagaaatttcataagatttttttattttc

SEQ ID NO: 841 - DNA, 1304 bp, Arabidopsis thaliana
cagcgaagaagaaagaaaaaaaaaagcgtattcctcagttgaaggaagaagatgacgtctgacggagcaacgtcgacgtcagctgcagctgcagcagcagcgatggcgacgaggaggaaaccgtcgtggagagagagggagaacaatcggagaagagagcggcggagaagagctgttgcggcgaagatttatactggtcttagagctcaaggtaactacaatcttccaaaacattgtgacaacaatgaggttcttaaggctctttgttctgaagctggttgggttgttgaagaagacggaactacttatcgcaagggacacaagcctctacctggtgacatggctggatcatcttctcgagcaactccttactcttcccataaccaaagtcctctttcttccacttttgatagccccatcttatcttaccaagtcagtccttcctcttcttcattcccgagtccttctcgagttggtgatccacacaatatctccacaatcttccctttcctcaggaatggtggtattccttcatcgcttcctccacttagaatctcaaacagtgctcctgtcactccaccagtgtcatccccaacttctagaaaccccaaaccattgcctacttgggaatcttttaccaaacaatccatgtccatggctgctaaacagtcaatgacttctttgaactacccgttttatgcggtgtctgcacctgccagtcctactcatcatcgccagttccatgctccggctactatacctgaatgtgatgagtctgactcttccactgttgattctggtcattggataagctttcaaaagtttgcacaacaacagccattctctgcctctatggtgccaacctcgcctaccttcaatctcgtgaaacctgcaccacagcaattgtctccaaacacagcagcaatccaagagattggtcaaagctccgagtttaagtttgagaacagccaagttaagccatgggaaggggagaggatccatgatgtggctatggaggatctagagctcacgcttggaaatggtaaagctcatagttgagatgaagtatacatgaacctgttatgtcatgtcggaaggaaggattggagaatgagaattagtgtgttgttcattcagttcatggttttggttcttgttctagaatcgatattcattgtaccagtgagtttgtttcacaacgcattatttgtagatagaatgtttaagatgtatgtttctattatcattccttttaggtcttgaaaacattacaaatatattacatgattaagtggcttgaaatg

SEQ ID NO: 842 - DNA, 3375 bp, Arabidopsis thaliana
atccggaaccaaagaaagaaactgtgtggtttcatgatggcacctttggtttctcttcttcattgaagggtcgaatttggtctgagaaaagaagagtggagagagagaaagagaagaggcaagagccccacaagagagacatgcttgtctgtgtagtccctattttgtatgttctttaatctctcccactctgtttttgtcatgtgtaagggttttgtccttcgattttggagtcttctttaaccaaaaaaaaacagattccatgaaatggctttgtctttaattcctctggtttgtcctggatttatcttcttgtagcctctttgctcaatagagctctttttgtctcttcttgtattaaataaaataaaatgaagacttagtaaagaaaaagaaaaactcttgagtcttgctaaagcctagttagtgttgagtgtgggagagacaaaacagaacattgaaaaatctctctgtatgatggcttcattgtcttgtgttgaagacaagatgaaaacaagttgtttggttaatggtggaggaactataacaacaacaacatctcaatctaccttgcttgaagagatgaagctgttgaaagaccagtcaggtacaagaaagccggtaataaactcggagctatggcacgcttgtgcaggccctttggtgtgtctccctcaagttgggagcttagtgtattacttctcacaaggtcatagcgagcaggttgctgtttcaaccagaagatcagcaacaacacaagttcctaattatccgaaccttccatctcagttgatgtgtcaagtccataatgttactcttcatgctgacaaagacagtgacgaaatctatgctcagatgagtcttcaacctgttcactctgagagagatgtgttccctgtaccagactttggaatgctgagaggaagtaagcacccgactgagtttttctgcaaaacacttactgcaagtgacacaagcacacatggaggtttctcagtgccacgtagagctgcagagaagctatttccaccattggactactcagcacagccgccaacgcaagagcttgtagttcgagatcttcatgagaatacttggacatttcgccatatctaccgagggcaaccaaagagacatctcctaactacaggatggagtttgttcgttggatcgaagagattgagagctggggattctgttttgttcatcagggatgagaagtcacaacttatggtcggtgttaggcgtgccaatcgccaacaaacagcacttccttcatcagttctctcagcggatagtatgcacatcggtgttcttgctgctgctgctcacgcaaccgccaaccgtactccttttttgatattctataatccaagagcttgtccagcagagttcgtgatccctctagctaagtaccgtaaggcgatatgcgggtctcagctctcagttggtatgagatttggaatgatgtttgaaactgaagattccgggaaacgaaggtacatgggaactattgttggaatcagcgatttggatccgttgagatggcctggttctaagtggcgtaaccttcaggtagaatgggatgagcctggatgtaatgataaacctactcgggtcagtccatgggatatcgaaacacctgaaagtctcttcatttttccttctctgacctcaggactcaaacgtcagctccatccatcttactttgctggtgaaactgaatggggtagcttgataaaacggccacttatacgtgttcctgattccgcgaatgggattatgccatatgcatctttccctagtatggcttcggagcagcttatgaaaatgatgatgaggcctcacaacaaccaaaatgtaccatctttcatgtctgagatgcagcagaatattgtaatggggaatggaggtttgctaggagatatgaagatgcagcaacccctgatgatgaaccagaaatctgagatggtgcagccacaaaacaagctaacagtgaacccatctgcttctaatacgagtggccaagaacagaatctttcacagagtatgagtgctcctgctaaacctgagaactctacactctctggttgcagctctggtagagtccaacatggacttgagcagtcaatggaacaggcaagccaggttactacatccacagtgtgtaatgaggaaaaggttaatcagctacttcagaaaccgggtgcttcgtcgcctgtacaagctgatcaatgtcttgacattactcatcagatttaccaaccacagtctgatccaataaatggattctctttcctggaaactgatgagctgacatcacaagtctcttccttccagtctcttgccggatcatacaagcaaccattcattctatcctcccaggattcttcagctgttgtgttaccggattccacaaactcaccgctgtttcatgatgtgtgggacactcagttgaacggtctcaagtttgaccagttcagtcccttgatgcagcaggacctttatgctagtcagaatatctgtatgagtaatagcacaaccagtaacattctagatcctccactctcaaacacagtccttgatgacttctgtgccatcaaagacactgatttccagaaccacccttctggttgtttggttggaaacaacaacactagctttgctcaagatgtccagtcgcagatcacatcagctagctttgcagactcacaggccttctctcgccaagattttccagataattctggaggcactggtacatcttcaagcaatgttgattttgatgattgtagtctgcggcaaaatagtaaaggctcatcatggcagaaaattgcgacaccccgcgtccgaacctacactaaggttcaaaaaaccgggtcagtcgggagatcaattgatgtcacaagctttaaagactacgaggagctaaaatctgctatcgaatgcatgtttggattggaaggactactaactcacccacaaagctcgggttggaagcttgtatatgttgattatgagagtgatgttctgcttgtaggagatgatccatgggaagagtttgtgggatgcgtaaggtgcataaggatattgtcgccaactgaggtccagcagatgagtgaagaagggatgaagcttttgaacagcgcaggcattaacgatcttaagacttctgtttcataaatgtaacaatataaaaatgatctcatgctgatttgtaagaaaaaaaagagagtaagaaatgttcttttctccaactggtagaggagaaaccatcttgttgtaagcatttgatgtgttgttccgatttgagacctgaaactatattcatattatgtagtagagtgatgaatgaatcagtagttgagacagtct

SEQ ID NO: 843 - DNA, 7031 bp, Arabidopsis thaliana
agatatatctgaagcttaaagggcagtgacaatggctggctcggttaacgggaatcatagtgctgtaggacctggtataaattatgagacggtgtctcaagtggatgagttctgtaaagcacttagagggaaaaggccgatccatagtattttgatagctaacaatggaatggcggctgtgaagtttatacgtagtgtcagaacatgggcttatgaaacatttggtacggaaaaagccatattgttggtggggatggcaacccctgaagacatgcggatcaatgcggagcatatcagaatcgctgatcagtttgttgaggttcccggaggaaccaacaataacaattatgctaacgttcagctgattgtggagatggctgaagtaacacgcgtggatgcagtttggcctggttggggtcatgcatctgaaaaccccgaattacctgatgccctagatgcaaaaggaatcatatttcttggtcctccagcatcttcaatggcagcactgggagataagattggttcttcgttgattgcacaagctgctgatgtacccactctgccatggagtggttcccatgttaaaatacctcctaatagcaacttggtaaccatcccagaggagatctaccggcaagcatgtgtctacacaactgaagaagcgattgctagctgtcaagttgtcggttacccagcaatgatcaaagcatcgtggggtggtggtggtaaaggaatcaggaaggttcataatgatgatgaggttagggctctattcaagcaagttcagggtgaggtcccaggctcaccaatattcataatgaaggttgcgtcacagagtcggcatctagaggtccagctgctctgtgacaagcatggaaatgtttcagctctgcatagccgtgattgtagcgtccagagaagacatcaaaagatcatagaggagggtccaattactgtggctccgccagaaactgtcaagaaacttgaacaagcagctagaaggttggctaagagtgttaactatgttggagctgctactgttgagtatctctacagtatggacactggggagtactacttcttagagcttaaccctcgcttacaggttgagcatcctgtcactgagtggattgccgagataaatcttcctgctgcccaagttgctgtggggatgggaattcctctctggcaaatccctgagataagacggttctatggaatagaacatggtggaggttatgattcttggcgaaaaacatctgttgtagccttcccttttgattttgataaagctcaatctataaggccaaaaggtcattgtgtggctgtacgtgtgacaagtgaggatcctgatgacgggttcaaaccaaccagcggtagagttcaggagttgagttttaagagcaagccaaatgtgtgggcgtacttctctgtcaagtctggtggaggcatccacgagttctcggattcccagtttggacatgtttttgcatttggggaatccagagccctggcgatagcgaatatggttcttgggctaaaagaaattcagatccgtggagaaattaggactaacgttgactacacgatcgaccttttacatgcttctgattaccgtgataacaaaattcacactggttggttggatagtaggattgctatgcgggtcagagctgagaggcctccatggtatctctctgttgtcggcggagctctctataaagcatcagcgaccagtgctgctgtggtttcagattacgttggttatctggagaaggggcaaatccctccaaagcatatatctcttgtacattctcaagtgtctctgaatattgaaggaagtaaatatacgattgatgtagtccggggtggatcaggaacctacaggctaagaatgaacaagtcagaagtggtagcagaaatacacactctacgtgatggaggtctgttgatgcagttggatggcaaaagccatgtgatatatgcagaggaagaagctgcaggaactcgtcttctcattgatggaagaacttgtttgctacagaatgaccacgatccatcaaagttaatggctgagacaccgtgcaagttgatgaggtatttgatttccgacaacagcaatattgacgctgatacgccttatgccgaagttgaggtcatgaagatgtgcatgccacttctttcacctgcttcaggagttatccattttaaaatgtctgaaggacaagccatgcaggctggtgaacttatagccaatcttgatcttgatgatccttctgctgtaagaaaggccgaacccttccatggaagtttcccaagattagggcttccaactgcaatatccggtagagttcatcagagatgtgccgcaacattaaatgctgcacgcatgattcttgctggctatgagcataaagtagatgaggttgttcaagacttacttaattgccttgatagccctgaactcccatttcttcagtggcaagagtgctttgcagttctggcgacacgactacctaaaaatctcaggaacatgctagaatcaaagtatagggaatttgagagtatttccagaaactctttgaccaccgatttccctgccaaacttttaaaaggcattcttgaggcacatttatcttcttgtgatgagaaagagagaggtgcccttgaaaggctcattgaaccattgatgagccttgcaaaatcttatgaaggtggtagagaaagtcatgcccgtgttattgttcattctctctttgaagaatatctatcagtagaagaattattcaatgataacatgctggctgatgttatagaacgcatgcgtcagctatacaagaaagatctgttgaaaattgtggatatagtgctctcacaccagggcataaaaaacaaaaacaaactcgttctccggctcatggagcagcttgtttaccctaatcctgctgcttacagagataaacttattcgattctcaacacttaaccatactaactactctgagttggcgctcaaggcgagtcaattacttgaacagaccaaactaagtgagcttcgttcaaacattgctagaagcctttcagagttagaaatgtttacagaggacggagaaaatatggatactcccaagaggaaaagtgccattaatgaaagaatagaagatcttgtaagcgcatctttagctgttgaagacgctctcgtgggactatttgaccatagcgatcacacacttcaaagacgggttgttgagacttatattcgcagattataccagccctacgtcgttaaagatagcgtgaggatgcagtggcaccgttctggtcttcttgcttcctgggagttcctagaggagcatatggaaagaaaaaacattggcttagacgatcccgacacatctgaaaaaggattggttgagaagcgtagtaagagaaaatggggggctatggttataatcaaatctttgcagtttcttccaagtataataagtgcagcattgagagaaacaaagcacaacgactatgaaactgccggagctcctttatctggcaatatgatgcacattgctattgtgggcatcaacaaccagatgagtctgcttcaggacagtggggatgaagaccaagctcaggaaagagtaaacaagttggccaaaattcttaaagaggaagaagtgagttcaagcctctgttctgccggtgttggtgtaatcagctgtataattcagcgagatgaaggacgaacacccatgagacattctttccattggtcgttggagaaacagtattatgtagaagagccgttgctgcgtcatcttgaacctcctctgtccatttaccttgagttggataagctgaaaggatactcaaatatacaatatacgccttctcgagatcgtcaatggcatctgtatactgttacagacaagccagtgccaatcaagaggatgttcctgagatctcttgttcgacaggctacaatgaacgatggatttatattgcagcaagggcaggataagcagcttagccaaacactgatctccatggcgtttacgtcgaaatgtgttctgaggtctttgatggatgccatggaggaactggaactgaatgcccataatgctgcaatgaaaccagatcacgcacatatgtttctttgcatattgcgtgagcagcagatagatgatcttgtgcctttccccaggagagttgaagtgaatgcggaggatgaagaaactacagttgaaatgatcttagaagaagcagcacgagagatacatagatctgttggagtgagaatgcataggttgggcgtgtgcgagtgggaagtgcggctgtggttggtgtcctctggactggcatgtggtgcttggagggttgtggttgcaaacgtgacaggccgtacatgcactgtccacatataccgagaagttgaaactcctggaagaaacagtttaatctaccactcaataaccaagaagggacctttgcatgaaacaccaatcagtgatcaatataagcccctgggatatctcgacaggcaacgtttagcagcaaggaggagtaacactacttattgctatgacttcccgttggcatttgggacagccttggaactgttgtgggcatcacaacacccaggagttaagaaaccatataaggatactctgatcaatgttaaagagcttgtattctcaaaaccagaaggttcttcgggtacatctctagatctggttgaaagaccacccggtctcaacgactttggaatggttgcctggtgcctagatatgtcgaccccagagtttcctatggggcggaaacttctcgtgattgcgaatgatgtcaccttcaaagctggttcttttggtcctagagaggacgcgtttttccttgctgttactgaactcgcttgtgccaagaagcttcccttgatttacttggcagcaaattctggtgcccgacttggggttgctgaagaagtcaaagcctgcttcaaagttggatggtcggatgaaatttcccctgagaatggttttcagtatatatacctaagccctgaagaccacgaaaggattggatcatctgtcattgcccatgaagtaaagctctctagtggggaaactaggtgggtgattgatacgatcgttggcaaagaagatggtattggtgtagagaacttaacaggaagtggggccatagcgggtgcttactcaaaggcatacaatgaaacttttactttaacctttgttagtggaagaacggttggaattggtgcttatcttgcccgcctaggtatgcggtgcatacagagacttgatcagccgatcatcttgactggcttctctacactcaacaagttacttgggcgtgaggtctatagctctcacatgcaactgggtggcccgaaaatcatgggcacaaatggtgttgttcatcttacagtctcagatgatcttgaaggcgtatcagcaattctcaactggctcagctacattcctgcttacgtgggtggtcctcttcctgttcttgcccctttagatccaccggagagaattgtggagtatgtcccagagaactcttgcgacccacgagcggctatagctggggtcaaagacaataccggtaaatggcttggaggtatctttgataaaaatagtttcattgagactcttgaaggctgggcaaggacggtagtgactggtagagccaagctcgggggaatacccgttggagttgttgcagttgagacacagactgtcatgcagatcatcccagccgatcctggacagcttgactctcatgaaagagtggttccgcaagcagggcaagtctggtttcctgattcagcggccaagactgctcaagcgcttatggatttcaaccgggaagagcttccattgtttatcctagcgaactggagagggttttcaggtgggcagagagatcttttcgaaggaatacttcaggcaggttcaactatagtagaaaatctgagaacctatcgtcagccagtgtttgtgtacatcccaatgatgggagagctgcgcggtggagcgtgggttgttgttgacagccagataaattcggattatgttgaaatgtatgctgatgaaacagctcgtggaaatgtgcttgagccagaagggacaatagagataaaatttagaacaaaagagctattagagtgcatgggaaggttggaccagaagctaatcagtctgaaagcaaaactgcaagatgccaagcaaagcgaggcctatgcaaacatcgagcttctccagcaacagattaaagcccgagagaaacagcttttaccagtttatatccaaatcgccaccaaatttgcagaacttcatgacacttccatgagaatggctgcaaagggagtgatcaaaagtgttgtggaatggagcggctcgcggtccttcttctacaaaaagctcaataggagaatcgctgagagctctcttgtgaaaaacgtaagagaagcatctggagacaacttagcatataaatcttcaatgcgtctgattcaggattggttctgcaactctgatattgcaaaggggaaagaagaagcttggacagacgaccaagtgttctttacatggaaggacaatgttagtaactacgagttgaagctgagcgagttgagagcgcagaaactactgaaccaacttgcagagattgggaattcctcagatttgcaagctctgccacaaggacttgctaatcttctaaacaaggtggagccgtcgaaaagagaagagctggtggctgctattcgaaaggtcttgggttgactgatatcgaagactttagcttctaatccaagaaagatggacatttaaagtttgcttgtgtccatttggaccatcttccttatatttgttggtcacagttgtaaatgttgttgtagctttgtcatttccgtataaacaaattacgcaataattcattcaacatgtcactcttgcttcatatttatacactgaaccaagacaatataatagtctaaatataaaactgatcttgctt

SEQ ID NO: 844 - DNA, 3042 bp, Arabidopsis thaliana
acttttctccatcatcatcaccatcggcgaaatccgccaaaaattgatctccatttggaaatccagatcatgctctagagccctagtttagatctcgaaggaagacaatgggacggatcttcgagtacttcgtcgtgtgcggacttggtccagagatgcgaaccgtggatggagatcttggattccatggaatgcaaacattctacttgcctgctcttcttgaccagttccctcctactgatcaatctccttaccctgcccctcctcctcagcttcctacttgtgttcttcctgctggggtggagttccattcttctggttttgtttccagtgaccctgcaagtttcccacggagctatcccatagtcttgacggagggtgatggatcaaaaatatttgtcagttgcattgcatttcgggatcgagtctgtgaggatattattgaagcttatcgcttaccgccgaatacatacgcagacaagtgtatctgtcttgtgtctcatgcccccaatttccgtgttcttcgtaattctctcgaagagatttttgttctttgcttctcttcagaaggaagctgtaagccattgtgggatattatcgcctatatggtatctaatgtgccattgccgactcccggaaaagacagagtcttgtttgctgtcgagaattgcctgctctcggtggaagcacctccagaggatagtcttcctcaggcagatatatctctccagcctcttgtacaatgcttggatgtcgacaacttgattaagctgtttacatctgtactagttgaaaggaggattttgattcgatccaacaagtattcgcttttgactctggtgtctgaatccatatgtcatttgatttatccttttcgatggctgcaagtctacattccattactattttttagtggagtagactacattgatgcaccaacaccatatatgatgggtctccactctgatgtcgatacatccaatcttgctatggatggcgttgtagtggtggatcttgacataaaccaaattactacttctgaagagatacctcagataccagagcctgagttcagcactttgcgaaacgatatcttgaaactactgcaccctaatgttgtagcgattgatcagttgaagggctttggtaattccgttgagcagtgccctaaaagccttagcaaaccttggggagaggatcatgaccttcaactcagggttatattcttaaagtgttttgcatctatcttgggtggctaccgcaatttcatagaaaacaaagtttttagcactgatgcgtttctgaagagacggtctcgttccacaaatcagccaccagagcctatgttggttcaattcttgggctcttttgcattcctcgattaccttgaaaggcgtctaagctctgatgagaagagtactaatctccttgagaagttacaagatgcagttggaaggggtcaagatgcaatgtcgattctgcctaaatcttctatggagcctgaaataatcacaatagccgagccagaagttgaagaatcagccaccaggtatacctatgacaggtttcctgcgagtgttcggtcagaggaacaagaagaaaagcgaaagcagatccttgcagcagcaagcggggctcttgaatccaatggaaggcaccctccaagctcaccgccagggaagaacaccaaagaagacaatttcagttcaatggagagggctgcagaaagagaacgaatggtcttggatatacaagtcaagttgcagggattatggctccgtcttctgaaactgggttcagatgaagatcctctttcttcattcgaatacggcacaatattggctctgattgaatctgatgctgaggggattggtgggagtggctttatcgagtgtatacgagagcatctgtattcgggctggcatggtcaattgtccgaggagcagttcattgcggtcaaagaattgctcaaaatggctgtgggccgtgctgcttcaagaagcgatttgtcgacagtgcgggatgcacttgaagtttctgcagaaatgttcaagaaggatgccaataatgtctctgactatgttcagcgtcatctcatctccatacccatctgggaggagttgagattttgggaaggttacttcgagtatctcatggagcagcctgcaaatgaatctgtgaactatgctactttggtcacagccagactaatcatagtggcatcacatatggctggcttgggacttcctgatacagaagcttggaacatgatcgagacaatagcagagaaacaaaagcttggatataaattactgattaaacttagagggttcctgtcgcatgttcagcaacttcgtgtcggctattggggtgcttcttcatttaagcagcaggccatatctgctgggttgccatccccgcgtccaaaagatgtctctgtctctgatgaaacccagcaaccctcagaagcttctggaaggagttgggttcagagtatgtttagcagagatacagcatcgagagcgaactcgttcagtcgtgttcgtaagtgggtatctgataatgcatcttcagacataactgctgctgcgcagaagaaaattcagaccaatgtacgtgttctgaagggtcacggtggtgctgtcactgccttgcactctgtgacaagaagggaagtctgtgatcttgtgggcgatcgcgaggatgctgggttctttatcagcggtagtacagactgtctggtcggtataaaatgcttgattggaaaaatgtttatatggttatttttcattcatcagttttttaatcatctagttgacgttgctttgcacctataaatgttcttgatatctacattgagaacacataaagagtgttatattatattagatctaaatatctaaaggatggttgcattcactatctgttaggcctaaagatcattacttagagggtcaaagggtagttcgctcatttgctattaattcttatctagattaagtgaattattttgcttttattgttaccacagtcgtggatata

SEQ ID NO: 845 - DNA, 1393 bp, Arabidopsis thaliana
attactacttaaaccaagggtcttcctcctcggacacacccaaatgatcccaataattattcttctctttatctctcttttcctcttaaccatccactaatcaaacactaaaacctagaaaaaaaaaggatcaaatcatggagacggaagaagagatgaaggaaagtagtataagcatggtggaggcaaagttgcctccgggattcagatttcacccgaaggacgatgagcttgtctgcgattacttgatgagacgatcgcttcacaataatcatcgaccacctcttgtcctgatccaagtcgatctcaacaagtgtgagccttgggacatcccaaaaatggcatgcgtgggagggaaggattggtatttctacagccaaagagaccgaaaatacgcgacggggctgagaactaaccgagcaacggccaccggatattggaaagccaccggcaaagacagaaccattctaagaaagggtaagctagttgggatgaggaagacattggttttctatcaaggtcgagctcctcgaggccgtaaaaccgattgggtcatgcacgaattccgtctccaaggatctcatcatcctcccaatcattctctgagctctccaaaggaagactgggtcttgtgtagggtattccataagaatacggaaggagttatatgtagagacaacatgggaagctgttttgatgagacagcctctgcatcgcttcctccactgatggatccttacatcaactttgaccaagaaccctcttcttatctcagtgatgatcatcactacatcatcaatgagcacgtaccctgcttctccaatttgtcacagaaccaaaccttaaactcgaacctaaccaactcagtctctgaactcaagattccatgcaagaaccctaaccccttgtttactggtggttcagcctcagccacgctcacaggcctcgactcattctgttcttcagatcagatggttctcagagctctactcagtcagctcactaagattgatggaagcctcgggcctaaagaatcacagagttatggagaaggtagctcggagagcctcctgaccgacatcggtattccaagcactgtttggaattgctgatgatcgagtgtaacgagagttactattgctatattcctatccatgattggaacaattcttcggggggaaataacgtgtgcttgtctgattgtacaaacatttcctcactcttgtacccacggtagattcatgtaaaataccacttatgacgctagacatacatatatttcatcgtagttccatttgtttcaaggtattaaggacctctagaacaattgatcaaaaagataatatgaaacatcactacctgtgtacatgatgggataggtgattgaatagcc

SEQ ID NO: 846 - DNA, 1363 bp, Arabidopsis thaliana
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggttggagcaccaccggaggttgtggcgaggctagaggaggcatgctcgtctgccgcagccgctgccgcatctatgggaccaacaggatgtctaggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttgatcgatcctttaaaacgtttatttcattatatttataatcgttaaacagcttataatatgtataatctatggttctcggtatacttggaacatatgaaacatgttccgattgatgaacaagcgtttgatgttgtggtgtgtatccttttgtgttgttctattgttatgcgaaattcctattcctattataatgatagtaaagcttttttgatcta

SEQ ID NO: 847 - DNA, 2465 bp, Arabidopsis thaliana
aactccacattaaaccaaaacctccaaaaagaatcatttatttaaattatcttcccgttttaagttcctgagatttttgggaattgtaaatttgaagaaaattaaacaaagacgtgttttcatttttttttttgtttcctttattgatctctctctatctctctaaatgagctaaatcgttaatggctgccatgtttaatcatccatggcctaatttaaccctaatttacttcttcttcatcgtcgttttaccattccaatcactttctcaatttgattctcctcaaaatatcgaaactttcttccccatctcttcactctcccctgttccaccaccgcttcttccaccttcgtcaaacccatctccgccgtcgaataattcatcatcttcggataaaaaaacaatcaccaaagctgtccttataacagcagcaagtactttacttgtagctggagttttcttcttctgcctccaaagatgtatcatcgcacggagacggagagacagagttggaccagtcagagtcgaaaacactttacctccgtatcctcctcctccgatgacgtcggcggcggtgactacgactactttggctagagaaggattcacgaggtttggtggtgtgaaaggtttgattcttgatgagaatggtcttgatgtgttgtattggagaaagctacagagtcagagagaaagaagtgggagtttcaggaaacagatcgtcaccggagaagaagaagacgagaaagaagttatttattacaagaacaagaagaaaacagagcccgttacagagattcctcttcttagaggaagatcatctacttctcacagtgttatccataacgaagatcatcagccgccaccgcaggtgaaacagagtgaaccaacaccaccaccgccaccaccgtcaattgcggtgaaacagagtgcaccaacgccatcgccacctcctccgattaagaagggttcttcaccatcgccaccgccacctccaccggtgaaaaaggttggagctttatcatcatcagcttcgaaaccaccacctgcgccggttagaggagcaagtggaggagagacttcgaaacaagtaaagttgaagcctttacattgggataaagtaaaccctgattccgatcattcaatggtttgggacaaaatcgatcgtggatcattcagtttcgatggcgatttaatggaagctctgtttggatacgttgccgtggggaagaaatcaccagaacaaggcgatgagaaaaaccctaaatcaacgcaaatattcatacttgatccgagaaagtctcaaaacacagcgattgtgctcaaatcattaggtatgacacgtgaagagcttgttgaatcactcatagaaggaaacgatttcgtgccagacactcttgagaggttagctagaatagctccaacgaaagaagaacaatcagccattcttgaattcgacggtgacacggcaaagcttgctgatgcggagacgtttctgtttcatcttcttaaatccgtgccaaccgcgtttacgagactaaacgcgtttctctttagggctaattattatccagagatggctcatcatagcaaatgtttacaaacgttggatttagcttgtaaagagctgagatctcgtggcttgtttgtgaagcttttggaggcaatacttaaagctggaaacagaatgaacgcgggtaccgcgagaggaaacgctcaagcgtttaatctaaccgcgcttttgaagctttcggatgttaaaagcgttgatgggaagacttctttgcttaactttgtagtggaggaagttgttagatcggaaggaaaacgttgtgttatgaatagaagaagccatagcttaacacgaagcggtagtagtaactacaatggtggtaatagtagtcttcaggttatgtcgaaagaagagcaagagaaagagtacttgaagcttggtttaccagttgttggtggattgagctctgagttttcaaacgtgaagaaagctgcttgtgtggactatgaaacggttgttgcaacttgttctgctcttgcggttagagcgaaagatgcgaaaacggtgattggagaatgtgaagatggagaaggagggaggtttgtgaaaacgatgatgacgtttcttgattcggtagaggaagaggtgaaaatagcgaaaggtgaagagaggaaagtgatggagcttgtgaaacgtacaacggattattatcaagcaggagctgttacaaaggggaagaatccacttcatttgtttgttatcgttagagattttcttgccatggttgataaagtttgcttagatattatgagaaatatgcagaggaggaaggttggtagtccgatatcgccttcttcgcagcggaatgcggtgaaattcccggttttgcctccgaatttcatgtcggacagagcttggagtgattctggtgggtcggattctgatatgtga

SEQ ID NO: 848 - DNA, 1751 bp, Arabidopsis thaliana
tctctctctcacacactaacagaaagcacaaaaaacagagacaaaagaatggcgcgaaaatccctaattttcccggtgattttgctcgccgttcttctcttctctccgccgatttactccgccggtcacgattaccgcgacgctctccgtaaaagcattctcttcttcgaaggtcaacgttccggtaaactccctccagatcaacgcttaaaatggcgccgtgactcagcattacgcgacggttcctccgccggcgttgacttatccggtggttactacgacgccggagacaacatcaagttcggttttccgatggcgttcacaacaacgatgctttcatggagtataatcgatttcggtaaaaccatgggacctgagcttagaaacgccgtgaaagctgttaaatggggaacagattacctccttaaagcgacggcgattcccggagtagtcttcgtccaagtcggagacgcttactccgatcataactgttgggaaaggcctgaagatatggacactctccgtactgtttacaaaatcgatagagctcatcctggttctgacgtcgctggtgaaaccgcagccgctttagccgccgcttcaatcgtttttagaaaacgcgatcctgcttattccagacttctacttgaccgtgccactagggtattcgcgtttgctaacagatatcgcggcgcgtatagtaacagtctctaccacgcggtttgtcctttttactgtgatttcaacggttaccaggatgagttactgtggggagcggcatggctacacaaagcctcgaggaaacgagcgtacagagaattcattgtgaagaacgaggtcattcttaaggctggagataccattaatgagtttggttgggacaataagcatgctgggattaatgtcttaatctccaaggaagtgttaatgggaaaagcagagtattttgagtctttcaagcagaacgcagatgggtttatctgttctatattgcctggaatttctcacccccaagtccaatactctcgaggagggctactagtgaagactggagggagtaacatgcaacatgtaacatcactatctttcctcctattggcttactctaattatctgagccatgccaaaaaggttgtgccttgtggcgaattaactgcttccccatctctcctccgtcaaatcgccaagcgtcaggtggattacattctcggagacaacccgatgggactgtcttacatggttggatacggtcaaaagtttccacgtaggattcatcaccgtggtagctcggttccttcggtttcagcccatccaagccacatagggtgcaaagaaggctctcgctatttcctaagcccaaatcctaacccaaaccttttggttggtgctgtagtcggtggacctaatgtcactgatgcttttccggattcaagaccttactttcagcagtctgagcccacgacttatatcaatgcaccactagtgggccttctcggttacttctccgcccattctacttggcgatgagggagggccttattacttattactctctatcctattagaggtgtgctggaaactttaggccaccctaaaacccttttttttcttttttaatgttattgccactctttattttctactacttaaccaattgtattgtaagcccgtaattagtgaagaagagaaagagttatgtcggtgtctaaacttattatatttgcagtcaattacttgaattatttgtttgc

SEQ ID NO: 849 - DNA, 2563 bp, Arabidopsis thaliana
atatcctcaaaaaccaaacttgctcactccacacacacactgctcccaagtcctctcacttcttcttcttcctccgacaccgttgcttaacggttttccatttttgtcccttcaagatgatctcatggcacgacctctacacggtcctcaccgccgtgattcctctctacgtggccatgatcctcgcttacggctctgtccggtggtggaaaatcttctcacccgaccaatgctccggaatcaaccgttttgtcgccatcttcgccgtccctctcctctcttttcacttcatctccaccaacaatccttacgcaatgaatctccggttcatcgccgccgacactctccaaaaaatcatcatgttgtcacttttagtcctatgggctaatttcactcgctccggtagcctcgagtggagcatcacaatcttttccctctccacacttcccaacactcttgttatggggattcctctcttgatcgccatgtatggcgaatactctggttccctcatggtccaaatcgtcgtcctccagtgtatcatctggtacacgcttctcctttttctcttcgagtttcgtggcgccaagatgctcatcatggagcagttccctgagacggctgcttccattgtttctttcaaagtcgaatccgacgtcgtttcgctcgacggccatgattttcttgagaccgatgcagagataggtgacgacgggaagcttcacgtcaccgtgagaaaatccaacgcttcacgtcgttcgttctgcggcccgaacatgactccacggccgtcaaatctcaccggagctgagatttatagtctcagcaccactcctagaggctctaatttcaaccactctgatttttacaacatgatgggtttccccggtggtcgtctctccaatttcggtccggcggatatgtactccgttcaatcatctagaggtccaactcctcgaccttcaaacttcgaggagaattgcgccatggcatcctccccgagattcgggtattaccctggaggaggagccgggtcttatccggctccgaatccagagttctcttcaaccaccacatctaccgccaataaaagcgtcaataaaaacccgaaagacgttaatacgaatcagcagacgactcttccaacgggcggcaagtcaaacagccatgacgccaaggagcttcacatgttcgtctggagctcaaacgggtcacccgtttcagaccgggcgggtcttaacgttttcggcggagcacctgacaacgatcaaggcggaagatctgaccaaggtgctaaagagatccgtatgttagtcccagatcaatctcacaacggcgagaccaaagctgtagctcatccagcaagtggagatttcggaggagaacaacaatttagtttcgccggaaaagaagaagaagcagagagaccaaaagacgccgagaatggtctaaacaaacttgctccaaattccacggcggcgctacaatccaagacaggtctaggaggagccgaagcaagtcaacgaaaaaatatgcctccggcgagtgtgatgacaaggctgatactgataatggtttggaggaaactcatcagaaacccaaacacttactctagtctcattggacttatttgggctctcgtcgctttccggtggcacgtggcaatgcccaaaatcattcaacaatctatctccattctatctgatgctggtcttggaatggcaatgtttagtttggggttgttcatggcgttgcaacccaaattaatcgcttgtgggaattcagtggcaacgtttgccatggcggttaggttccttacgggtccggccgtgatggcggttgctgctatagccatcggattacgtggtgatttactgcgtgtcgctatagttcaggccgcattacctcaaggaattgtgccctttgtgtttgcgaaggagtacaatgttcatcctgctattttaagtacaggggtaatatttggaatgcttatagcgcttccgatcacgctggtttactacattctactcgggttataagctttcggttatgaaagccccgagaaagagtcaattgtagagggagaaggaagaaagggaaactagagagtgtctcatggaacaaactaaaaaaagcttagagtatgtaagtacaactagggagtagcatgatttaaggaatgctgatgccaacattacaagccaagaaaccctttcttctcccatattttttatatatagaatattgggagattatttgagtgagacaatgggacgcagataaggaggagcaaaacatggggcaacgagacaaagaaaagataaataaaagattggaagatgaagacaacttattatttttgtaacttttatttttcttacacagtctttttttttttttttttgtgttctttgattaggttcgggtaactcttagttgattattgtgtagattttttttagcgaagaaaagtgtggttttgattttgaatattcccttgttccagtttcacatgagcaaataacgctttaaaagtaaacagtttatattattattcttaatt

SEQ ID NO: 850 - DNA, 3113 bp, Arabidopsis thaliana
atggatgaccttgaacaggcaatagtaattagctttgaaactggtgctgttgattcggctttaaagtctcaagctgttacttattgtcagcaaatcaaagagactccttctatttgtagtatatgtattgagaagttatggttttctaagcttgtccaagttcagttctggtgtttgcaaacgcttcaggatgttttaagggttaaatatggatctatgagcttggatgagcagagttatgtgaggaaatcagtgttttcaatggcttgtttggaggttattgataatgagaatgctggtagagttgtggaaggacctccttttgttaaaaacaagcttgcacaggttttggctactttgatctattatgagtaccctttgatttggtcctcggtgtttcttgatttcatgcttcatttgtgcaaaggtgctgttgtgatcgacatgttttgtcgggttttgaatgccttggacgatgagttgattagcttggattacccccggacaccagaagagatatctgttgctgctcgagtcaaggatgcaatgaggcaacaatgtgtccctcagatagccagagcatggtatgacattgtatcgatgtacaagaattccgatcctgatctttctgctactgtgttagattgcatgagaagatttgtatcttggattgacattggtttggttgccaatgatgcatttgttccactgctgtttgaattgattttgtctgatggattgtctgaacaagtccgcggtgcagcagctgggtgtgtcttagccatggtttctaagcggatggatccccagtcaaaactgccccttttgcagacccttcaaatcagtcgtgtttttggtttagtatccggagatgttgattccgatttggtatcaaaagtatctgctttgcttactggctatgctgttgaggttctagaatgccataagcgtttgaactcagaggacaccaaggcagtctccatggatttgctgaacgaagttctgccatcagttttttatgtcatgcagaagtgtgaggtggattctacttttagcatcgtccagtttctcctgggttatgtttccactctcaaaggcctccctgcattgaaggagaagcagctgctccacattacacagattctcgaagtgataagaattcagatttgctatgatcctatgtatcgtaataaccttaattcactggataaaactggattggaggaggaagatagaatgtccgagtttagaaaagatctctttgtcttattacgtacagtgggccgtgttgctcctgaagttactcagcatttcattcgtaactcactagcaaatgctgttgaatcttcatcggagagcaatgttgaagaagtggaagctgcgctctcgcttttgtattcattcggagagtctatgaccgaggaggccatgaaaacaggatctgggtgtttgagtgaactaattccgatgctcttgaccacacagttccctggtcattcacatagacttgttgcactagtgtacttagaaaacataacaaggtacatgaagtttattcaggaaaactcccagtacattcccaatgttcttggtgctttccttgatgataggggtttgcatcaccagaatttctatgtgagccgtagagctggttacttgttcatgagagtcgtgaaattgttaaaatcaaagcttgtaccattcattgacaagatcttgcagaaccttcaagatacgttgtcccagttgacgactatgaactttgcatcaagagaacttactggaactgaagatggcagtcacatttttgaggctattggcataatcatagggttggaggatgtcccggctgaaaagcagtcagattatttgtctttactgcttacccctctctgtcaacagattgaggcaggacttgtgcaggcaaaagttgcaagttccgaagactttcctgtgaaaattgcaaatatccaatttgctattgtggcaattaatgcgctcagcaagggcttcaacgaacgtcttgttactgctagtcgtcctggaattggtctcatgtttaagcagacactggatgttcttctaagggtgctaattgaatttccaaaggtcgagcctttgcggagtaaggtcacatcattcatacaccgtatggttgatacccttggatccgctgtgttcccttatcttcccaaggctttggaacagctacttgctgacagtgagccaaaggaaatggttggtttcatggtattactcaatcagcttatctgcaaattcaacagcgctctccatgatatactggaagaagtatatcccgtggttgctgttaggattttcaatgtaattccaagagatgggctcccttcacgccctggggctgttactgaggaaatgagggaactgatagagcttcaaaggatgctgtatacatttcttcatgttatagccacacacgatctttcttctgtatttcttacgccgaaaagtagggcgtatctagatcctatgatgcagctggttttgaatacttcttgtaatcacaaggatattaccgtacgtaaggcgtgcgtgcagatatttataaagcttattaaagattggtgtgccgagccatatagcgaggagaaggttccaggttttcagaatttcgtgatcgaagcgtttgcaacaaactgttgtttgtacagtgtgctagataaatccttcaatttcagtgatgcaaatacgcacgcattgttcggggaaatcatcacggctcagaaagtaatgtatgaaaaatttggtaatacgtttctcatgcatcttatgtcgaaaagtttcccatcagcacatattccacaagatttggcggagcagtattgccaaaagttgcagggcaatgatatccgaagcctcaagtcatactaccagtcccttatagaaaatctccggcttcaacaaaacgggagtcacgttttcagatagcattcgaaatacagctagtttcatagaaagaaaggcttctccagatgtaaatagtatttgtcaatgtctacttgagaggtggcaacaaggttcgctttcaccatccagatcaaattagatcaaaagcttgagagagattcatactg

SEQ ID NO: 851 - DNA, 1659 bp, Arabidopsis thaliana
agatgaaaaaaatattattatttgttggagaagaaagagagattcttcttcttcgattccagcgaaggaaaagcgtattcctcgtgagcactaacttctcactcctctcttcttcttcttcatcagtctacgttcacacaatctttcacccacctattcaaagctctctccggaagtttcgaggggttggttgttggttttcccgatgacttcggatggagctacgtcgacatcagcagctgcagctgcggcggcggcagcagcggcgaggaggaagccgtcgtggagagaaagggagaataatcggaggagagaaagacggagaagagctgtagctgcgaagatatacactgggcttagagctcaaggtgattataatttgcctaaacattgtgataataatgaagtccttaaagctctttgtgttgaagctggttgggttgttgaagaagatggtactacttatcgcaagggatgcaagcctttacctggtgagatagctgggacttcatctcgagtaactccatattcatcacagaaccagagccctctttcatcagcctttcaaagtcccatcccatcttaccaagttagcccgtcttcttcatcattcccgagtccttctcgcggtgaaccaaataacaacatgtcctctacattcttccctttcctcagaaatggtggcattccttcttctcttccttccctcagaatctcaaacagttgtccagttaccccaccggtctcatcgccgacttctaagaacccgaaaccgttgcctaactgggaatctatcgctaagcaatccatggccattgctaaacaatcaatggcgtcttttaattatcctttctatgcggtttctgcacctgctagtccgacacatcgccaccagtttcataccccggctactatacctgaatgtgatgagtctgactcttccactgttgattctggtcattggataagctttcagaagtttgcacaacaacagccattctctgcctctatggtgccaacctctcctaccttcaatcttgtgaaacctgcgcctcagcagatgtctccaaatactgctgccttccaagagattggtcaaagctctgagtttaaatttgagaatagccaagttaaaccctgggaaggagagaggatacatgatgtgggtatggaggatcttgagcttacacttggaaatgggaaggctcgtggttgacataaacaactaggcaaacccaaatggcatgtcattggaatatgagaaactaatcctcttgagtattttcttcttcgtccagtctcaacattacattcttggtatctgaaacaagctgtgagatgatcattaacaatgccagaggcctgcaagaaggaatacataacagtaggaccaacgcagcgaaaccctctctgcatcatatctttgctaatgtactctgcctttggggacttaaccggtacttgacgaccatatcgatagccatttcttaatggcttgtggttcacaaatctccaacaataattactgaacgatccaaattcctgcttgacctgttttcagattacaaccaaagctatttcagtaaacacatagtatctacaatttcatagcaaaacacacagtgcctaccttgagaacagatttcgcgttctctacaa

SEQ ID NO: 852 - DNA, 667 bp, Arabidopsis thaliana
aggacacaacaactaaaaccacatttatcattacagtctgatttgagctaagttctctcatcataaactctccttggagaatcatggctatttcaaaagctcttatcgcttctcttctcatatctcttcttgttctccaactcgtccaggctgatgtcgaaaactcacagaagaaaaatggttacgcaaagaagatcgattgtgggagtgcgtgtgtagcacggtgcaggctttcgaggaggccgaggctgtgtcacagagcgtgcgggacttgctgctacaggtgcaactgtgtgcctccgggtacgtacggaaactacgacaagtgccagtgctacgctagcctcaccacccacggtggacgccgcaagtgcccataagaagaaacaaagctcttaattgctgcggataatgggacgatgtcgttttgttagtatttactttggcgtatatatgtggatcgaataataaacgagaacgtacgttgtcgttgtgagtgtgagtactgtattattaatggttctatttgtttttacttgcaagttttcttgttttgaatttgtttttttcatatttgtatatcgattcgtgcattattgtattatttcaatttgtaataagattatgttacctttgagtggttgtttatcatactttttttctatgg

SEQ ID NO: 853 - DNA, 1619 bp, Arabidopsis thaliana
atctccagatcccaaaatcttcatcgatcatcatcatcatgagagaaatcctccacgtccaaggcggccaatgcggtaaccaaatcggttccaaattctgggaagttatctgcgacgaacacggcgttgatcccaccggacgttacaacggtgattccgccgatcttcagctcgaacgtatcaatgtttattacaatgaagcttctggtggtcgttacgttcctcgtgctgttctcatggatctcgagcctggtactatggatagtatcagatctggtccctacggtcagattttccgtcctgataacttcgtctttggtcaatccggtgccggaaataattgggcgaaaggtcattatactgaaggtgctgaacttattgatgctgttctcgatgttgttcgtaaggaagctgagaactgtgattgccttcaagggtttcaagtatgtcactctcttggaggaggcacgggttcaggaatgggaactctcttgatatcaaagatccgtgaggaatacccagacagaatgatgctcacattctctgttttcccatctccaaaggtctcagacacagtcgttgagccgtacaatgcaactctctcagtccaccaacttgtagagaatgctgatgaatgcatggtcctcgacaacgaagctctttacgatatctgtttccgcactctcaaactcagcactcctagctttggagacttgaaccacttgatctccgcaactatgagtggtgtgacttgctctttaagattccctggacaactcaactctgaccttaggaaactcgccgtgaaccttatcccattccctcgtctacatttcttcatggttggtttcgcccctctcacttcccgtggctctcaacagtacatctctctcacagtcccggagctgacacagcaaatgtgggacgctaagaacatgatgtgtgcagctgatccacgccacggacgttacctcacagcttcagccatgttccgaggaaaaatgagcacaaaggaagtggacgaacagatcctaaatgtccagaacaagaactcatcctactttgttgaatggatcccaaacaatgtgaagtccagcgtctgcgacattccaccaactggaatcaaaatggcttccacgtttgtcggaaactcgacttcgatccaggaaatgttcaggagagtaagcgaacagttcacggctatgttcaggcgtaaagctttcttgcattggtacacaggagaaggaatggacgagatggagttcactgaagcagagagcaacatgaatgatctggtctctgaataccaacaataccaagatgctaccgctgatgaagaagacgaatatgatgaagaagaagaacaagtttacgaatcttgatcttacaacacaaaccaaaagatgaaaaaacacagaagtcacatctctatctcttttattgaaatctctattcctactattaccactatatatatatatacatgtatcaagttgaagaatctgggaaatgtgtttgtttgtttgttactttatctttgtggttctctcttattgtattttgcaacttagtttcttcttttcttctcattgcctttataataaagagtctgtccacgt

SEQ ID NO: 854 - DNA, 1104 bp, Arabidopsis thaliana
acttcccatcaccttttgtatcattgctatctttgttcttccttctggtgtctcttcagtgtaacaaaaagtctctttttcagttatattaagtaaaagatgatgcttgcggtggaagatgtgttaagcgaactcgccggagaagaaaggaacgagagaggattgccacctggcttccggtttcacccgacggacgaagagctcattaccttctacttagcttccaaaatcttccatggtggtctctccggcattcacatttccgaagttgatctcaaccgctgtgaaccttgggagctaccagaaatggcgaagatgggagagagagagtggtacttttatagtctaagggacaggaaatatccgacaggtttgaggactaacagagcaactactgctggatactggaaagctaccggcaaagataaggaagtcttctccggcggaggaggacagcttgttgggatgaagaagacgttggtgttctacaaaggtagggctccacgtggcctcaagactaagtgggtcatgcatgagtatcgcctcgaaaacgaccattcacaccgccacacgtgtaaggaggaatgggtgatttgcagagtgttcaataaaacaggagacagaaaaaatgttggattaatccataaccaaatcagctaccttcataaccattcactctcaacaacacatcatcatcatcatgaagccttacctttgcttatagaaccttccaacaaaaccctaaccaacttcccatcactactctacgatgatccacaccaaaactacaataataacaacttccttcatggatcatcaggccacaacatcgacgagctcaaagccttaatcaaccctgtcgtctctcagctcaacggtatcatctttccttcagggaacaacaacaacgacgaagacgacttcgactttaacctcggcgtgaaaacagagcagtcttcgaacggtaacgaaattgacgtacgagattacttggagaaccctctgtttcaggaagcgagttatggtctgttgggtttttcgtcttctcctggacctcttcacatgctactagattctccatgtcctttaggattccagctgtag

SEQ ID NO: 855 - DNA, 1214 bp, Arabidopsis thaliana
tatataaagccaaccacacccctttagcttctctcaccatcatcatcatcatcatcatcatcatttctctctatctctttctaaaacacaaccatgactgtttcttcatctccatgggctctcatggctctctttctaatggtttcttcaacaatggtaatggctattcctccacgcaaggccattgatgtaccatttggtcgtaactacgtcccaacttgggcttttgaccaccagaaacagttcaatggcggttccgaacttcagcttatcctcgacaaatacactggcacaggatttcaatcaaaggggtcatatttgtttggacattttagtatgcacataaagcttccagctggtgacacagccggagttgtcacagctttctatctatcatctaccaacaatgagcatgacgagatagactttgagttccttggaaacagaacaggacaaccagctatattacagacaaatgtattcacaggaggaaagggaaacagagaacaacgaatctatctctggtttgatccttctaaggcttatcacacttactcaatcctttggaacatgtaccagatcgtattctttgttgacaacataccaatccgaacgttcaagaatgctaaggatctaggagtacgtttcccattcaaccaaccaatgaagctttactcaagcctttggaacgcggatgattgggccacgagaggcggtttagagaagaccaattgggccaatgcacctttcgttgcatcttacaaaggattccacatagatggttgccaagcttctgtggaagccaagtactgtgccacacaaggccgcatgtggtgggatcagaaagagttccgtgaccttgacgctgaacaatggcgtcgtctcaaatgggttcgtatgaagtggaccatctacaactactgtaccgaccggactaggttcccggttatgccagctgaatgtaaaagggacagagacgcataagttactactcttgagggttttaatgaatttatgctatcattattatttgaattatgcttgttcaagagattgatatatgtattgtttgttggcccatgatgtttatgctatatttgggcctaaaattacatgttataattcatatatgtattgattagctatgtattttcatatgttatgatctacttacaagttttattctttaacgtggtaaaagtgcatttggtatt

SEQ ID NO: 856 - DNA, 3996 bp, Arabidopsis thaliana
cttcaatttattttattggtttctccacttatctccgatctcaattctccccattttcttcttcctcaagttcaaaattcttgagaatttagctctaccagaattcgtctccgataactagtggatgatgattcaccctaaatccttccttgtctcaaggtaattctgagaaatttctcaaattcaaaatcaaacggcatggtttccggagtcgggggtagtggcggtggccgtggcggtggccgtggcggagaagaagaaccgtcgtcaagtcacactcctaataaccgaagaggaggagaacaagctcaatcgtcgggaacgaaatctctcagaccaagaagcaacactgaatcaatgagcaaagcaattcaacagtacaccgtcgacgcaagactccacgccgttttcgaacaatccggcgaatcagggaaatcattcgactactcacaatcactcaaaacgacgacgtacggttcctctgtacctgagcaacagatcacagcttatctctctcgaatccagcgaggtggttacattcagcctttcggatgtatgatcgccgtcgatgaatccagtttccggatcatcggttacagtgaaaacgccagagaaatgttagggattatgcctcaatctgttcctactcttgagaaacctgagattctagctatgggaactgatgtgagatctttgttcacttcttcgagctcgattctactcgagcgtgctttcgttgctcgagagattaccttgttaaatccggtttggatccattccaagaatactggtaaaccgttttacgccattcttcataggattgatgttggtgttgttattgatttagagccagctagaactgaagatcctgcgctttctattgctggtgctgttcaatcgcagaaactcgcggttcgtgcgatttctcagttacaggctcttcctggtggagatattaagcttttgtgtgacactgtcgtggaaagtgtgagggacttgactggttatgatcgtgttatggtttataagtttcatgaagatgagcatggagaagttgtagctgagagtaaacgagatgatttagagccttatattggactgcattatcctgctactgatattcctcaagcgtcaaggttcttgtttaagcagaaccgtgtccgaatgatagtagattgcaatgccacacctgttcttgtggtccaggacgataggctaactcagtctatgtgcttggttggttctactcttagggctcctcatggttgtcactctcagtatatggctaacatgggatctattgcgtctttagcaatggcggttataatcaatggaaatgaagatgatgggagcaatgtagctagtggaagaagctcgatgaggctttggggtttggttgtttgccatcacacttcttctcgctgcataccgtttccgctaaggtatgcttgtgagtttttgatgcaggctttcggtttacagttaaacatggaattgcagttagctttgcaaatgtcagagaaacgcgttttgagaacgcagacactgttatgtgatatgcttctgcgtgactcgcctgctggaattgttacacagagtcccagtatcatggacttagtgaaatgtgacggtgcagcatttctttaccacgggaagtattacccgttgggtgttgctcctagtgaagttcagataaaagatgttgtggagtggttgcttgcgaatcatgcggattcaaccggattaagcactgatagtttaggcgatgcggggtatcccggtgcagctgcgttaggggatgctgtgtgcggtatggcagttgcatatatcacaaaaagagactttcttttttggtttcgatctcacactgcgaaagaaatcaaatggggaggcgctaagcatcatccggaggataaagatgatgggcaacgaatgcatcctcgttcgtcctttcaggcttttcttgaagttgttaagagccggagtcagccatgggaaactgcggaaatggatgcgattcactcgctccagcttattctgagagactcttttaaagaatctgaggcggctatgaactctaaagttgtggatggtgtggttcagccatgtagggatatggcgggggaacaggggattgatgagttaggtgcagttgcaagagagatggttaggctcattgagactgcaactgttcctatattcgctgtggatgccggaggctgcatcaatggatggaacgctaagattgcagagttgacaggtctctcagttgaagaagctatggggaagtctctggtttctgatttaatatacaaagagaatgaagcaactgtcaataagcttctttctcgtgctttgagaggggacgaggaaaagaatgtggaggttaagctgaaaactttcagccccgaactacaagggaaagcagtttttgtggttgtgaatgcttgttccagcaaggactacttgaacaacattgtcggcgtttgttttgttggacaagacgttactagtcagaaaatcgtaatggataagttcatcaacatacaaggagattacaaggctattgtacatagcccaaaccctctaatcccgccaatttttgctgctgacgagaacacgtgctgcctggaatggaacatggcgatggaaaagcttacgggttggtctcgcagtgaagtgattgggaaaatgattgtcggggaagtgtttgggagctgttgcatgctaaagggtcctgatgctttaaccaagttcatgattgtattgcataatgcgattggtggccaagatacggataagttccctttcccattctttgaccgcaatgggaagtttgttcaggctctattgactgcaaacaagcgggttagcctcgagggaaaggttattggggctttctgtttcttgcaaatcccgagccctgagctgcagcaagctttagcagtccaacggaggcaggacacagagtgtttcacgaaggcaaaagagttggcttatatttgtcaggtgataaagaatcctttgagcggtatgcgtttcgcaaactcattgttggaggccacagacttgaacgaggaccagaagcagttacttgaaacaagtgtttcttgcgagaaacagatctcaaggatcgtcggggacatggatcttgaaagcattgaagacggttcatttgtgctaaagagggaagagtttttccttggaagtgtcataaacgcgattgtaagtcaagcgatgttcttattaagggacagaggtcttcagctgatccgtgacattcccgaagagatcaaatcaatagaggtttttggagaccagataaggattcaacagctcctggctgagtttctgctgagtataatccggtatgcaccatctcaagagtgggtggagatccatttaagccaactttcaaagcaaatggctgatggattcgccgccatccgcacagaattcagaatggcgtgtccaggtgaaggtctgcctccagagctagtccgagacatgttccatagcagcaggtggacaagccctgaaggtttaggtctaagcgtatgtcgaaagattttaaagctaatgaacggtgaggttcaatacatccgagaatcagaacggtcctatttcctcatcattctggaactccctgtacctcgaaagcgaccattgtcaactgctagtggaagtggtgacatgatgctgatgatgccatattagtcacacttcagttggtatgagagtttgtatcattgtatgagtgtttgtgtgtctaacgacgtcggaggaggatagaaagttttttttttgtttccggtgagattagtagagaagagggagattatttgcgttcagctcagctcgccggaaaaaaaacgtaacagtagttgtagagaatttcaagacttttgtttgtgctgtgtaaattgacaactccgagagaaacaaaacaatgagataagaagagagcatattaatcgatgaccaatccttttaatt

SEQ ID NO: 857 - DNA, 2416 bp, Arabidopsis thaliana
gacggtgatgaagaccagctcaaagccaggtcaaaatccatcaatcctggcctcatcaatgttaaaaatctttactttcacacatctctagatcttccatagaaggatcaatcaaaagctgtaatctttctttcttcctcgtagctccttctcttgcggatccttgtcggtacacttctacattctcaaatctgattcctttctggagttgctcctgagctacggttcagcttcaattacttcgatctcgtgtaaaaatcacttctagaagctttgataagctttgataggagttggttttactctttagggttttgtttgagtttgatctttattgtatagatgttgtgatcttcgtacactctatatatgtttccaagggtttctatgaggcgtcgctctgctgaagtttctcctacagagccaatggagaagggaaatggaaaaaatcagactaatcgaatctgtttgttggttgctttgtcactctttttctgggcattgttgttgtacttccattttgttgtcttagggactagtaacattgataaacagctccaattgcaacctagttatgctcaatctcagccatcatcagtctctcttcgtgttgataaattccctatagagcctcatgcagctccatcgaaaccacctcccaaagagcctttagttactatcgataagccaatactccctcctgcaccagtagccaattctagttccacctttaagccacctagaattgttgagagcgggaagaaacaggagttttcgtttataagagccttgaagacagtagacaacaagagtgacccttgtggagggaagtacatttatgttcacaatctaccctcaaagttcaatgaggatatgcttagagactgtaagaagcttagtctctggactaacatgtgtaagttcacaaccaatgctggccttgggccgccgcttgagaatgttgaaggtgtcttctctgatgaaggttggtatgcgactaatcagtttgctgttgatgtgatattcagcaaccggatgaagcagtacaaatgtttgacaaatgattcttcccttgctgctgccatctttgtgccgttctatgctggattcgacattgctaggtatctgtggggatacaatatctcgagaagggatgctgcttcgcttgagttggtcgattggctcatgaagcggcctgagtgggatataatgaggggaaaagatcatttccttgtggcgggtaggataacgtgggattttaggagattgtctgaagaagaaactgattggggcaacaagcttctcttcttaccggctgccaagaacatgtctatgcttgtggttgagtcgagcccatggaatgctaatgattttgggatcccgtacccaacctacttccacccagcaaaggactcagaggtttttgaatggcaagaccggatgagaaacctggaaaggaagtggcttttctcgtttgcaggagccccacgacctgacaatccgaaatctatcagagggcagatcattgatcaatgtcgaaactcaaatgttggcaaattattagaatgcgattttggggagagcaaatgccatgcaccaagcagcattatgcaaatgtttcaaagctctctcttctgcctgcagccacagggagactcttacacccgaagatcggcatttgactcaatgcttgccggttgtataccggtcttcttccatccgggttcagcctacacgcaatacacgtggcatctacccaagaactacacaacctactcggtattcatccccgaggatgatgttcggaagagaaacataagcatcgaggagcgactcctccagattccagccaagcaggtcaagataatgagagagaatgtcatcaacctcatcccaaggctgatctacgcagacccgagatcagaactggagacgcagaaagatgcatttgatgtctcggtacaggctgtgatagacaaggtgactcggttaaggaagaacatgatcgagggccgaaccgagtatgactacttcgtggaggagaacagctggaagtatgcgttgctggaggaaggccaacgggaagcagggggccatgtgtgggacccgttcttctccaaaccaaagcccggagaagatggcagcagcgatggtaatggaggcacgactatttcagcagatgcagctaagaattcatggaagagtgagcagagagataagacacagtgaaaagagacagaaaccacattttgttacggttttgatatagttttcggttactatttatacggacaaaaaatgatttatttttgttgtattggtatcaaatgtagtttctccagtttcatagagataagtttgtttgtatcagttacccacagaaattaataataagaagtgacccttttcaagtttc

SEQ ID NO: 858 - DNA, 2419 bp, Arabidopsis thaliana
gatgatgaagttagccaagagagagataacaaaaacatgtggctgtgtatgtaaaagaccgagtcacccgaacatctccaccttcacgccattctcctaccactcggacctaaccaaccaataccttccacgtcatgtacaatccgagttcccgtgagatagggatctttacttgaagcaaccagacatgaccgcagagtcacacacacacacacccctaagctttttgtcgtcccctcgtatggaatccattgtgggacgacacaaaaatatcttcttttgcttctctgctttcttcttcttcttcttaaaatttgtttctttcaggtggatttgatctccatctacgtaaaacaaaaacaaagtttataatctttttggattttgggattgatctaaagtgagatttcgatcttggcactaggttttgcaagggaaaagatgggaggaatgaaagatgaagcaaagaggataacaattcctccattgtttccaagggttcatgtcaatgatactggaagaggaggcctgtctcaacaatttgatggcaaaacaatgtctctcgtctcttctaaacgtcccaatcttccttctccgaccaacaacatatctgattctctttccactttctctttgtctcttcctccaccaccaaacaatgcccgtctcattgatggacctgaaaagaatcagttttcaccaatctacaacacaaagtttgaggggaagctgaataaaaaaggcataaattatacaagtcctaaaggatcatcagttactaatactaagcctagttcaataaaacaaaatgagtacctcaagaaccttaccagcttggattctattaagtctcctattgttatacactcagaaatagatccacaagcaaacacagatttgtcactccaattttgtactagcggtagcagtaaacccggaggagaggctgttgttggttctaagatccttttgtcagaacgtttggaagatgaaaaccagaatgggtctcccaatgtgatgaaaactcaatcatatagaagaaactttgctgagtttaacaatgaaactcaaaagaagcccaaaactctgcctcggcgtgaacaagttgcttcaaactgctctgcaatagagtctttgtctggtataagtgcatcttcttatgatattgccagagtgattggtgaaaagaggttttggaagatgagaacatatatgatcaatcagcaaaagatctttgccgggcaagtatttgagctccatagactgataatggttcaaaagatggttgcgaagtcgccaaacttgtttcttgaaagtaagcttaatggtgtcaaacatggtacaatgaggtcatcacatcagcttgcaatggcggcttcaaaggttagaaagccaaacactgagaatcacaaacctgtacctgaagaatatccagagcatatgaaaccaaagcttcctctaccttccataagcaaagaactcgtgactcctatttggccacaacagctacttcctcctcctggaaaccaatggttagttcctgtaataactgattcagacggtctggtctataaaccatttccaggaccatgtcctccttcttcttcagccttcatggttccagtttatggccaagattcactcgagacaccattcaggttccctgtttcttctccattcagccacagctacttcccacctcctaacgcgaggacaacagttgaccaaacaaacccgtttggtcagtttcaaagatggtctaacacatcaagccacatgacacaagccattccattttctttaaagaagtctcaggaatctaatgacagtgacatacatggaagcacagcttcaagtccaccagagaagcataaacttgaagtgcttcctctgtttcctacagagcctacccatcaaactgatgagtacaagcagaaacagcaaccgatgcttcgcgccattaaagccgttcctcataattcaacatctgcctctgaatctgctgcaaggatcttccgtttcattcaggaagaaaggagggactcagatcatatgattagttagttcttttatatttgaaacccttccacattcttttgctctcattgcttcttcatctagcttagattttcagtatattctatttactcttcttatgaagatgtaaatcaaatactatcactatacattaaacatacacacacttatacacacatcttacattgttcttgtattgacaaacagctaataaaagatagacttttgtgcttctattccagttttgaggagtttaaacattggaacaagaagagttctttagccattgaagtatctatattatcaatgtggaaggagacaataaggatcagagttgtgtccatgctatacgaagctacactcaagttcaagaacatttcag

SEQ ID NO: 859 - DNA, 1970 bp, Arabidopsis thaliana
aatccaaaaagaaacaagataagaagaaaccaaactcgcaaagaaacaaaaaggaaaaaaaaaaaaaaaacgaattaaaaaaagaagaaataaatcctcctttttaacacctcattccctctttctccggcactcaaaagagaccaaagaagaaaactttagctctcctttttgtgttttctctcttttctttgttggtgttccgacaatggaggaagaaagtagcagctggttcattccaaaggttcttgttctgtctgtaatcttaagtcttgtaatagtgaagggtatgtctctgttatggtggagaccaagaaagattgaagaacatttctctaaacaaggaattcgaggtcctccttatcatttcttcatcggaaatgttaaagaacttgttggaatgatgcttaaagcttcttctcatcctatgcctttctctcacaatattcttcctagagttctctctttttaccatcactggagaaaaatctacggtgctacatttctggtttggttcggtccaactttccggttaacggtagccgatcctgatttgatcagagagatcttctctaagtctgagttctacgagaagaatgaagctcaccctttggttaaacaacttgaaggcgatggactacttagtctcaaaggtgaaaaatgggctcatcatcgaaaaatcattagccctacttttcatatggagaatcttaagttgcttgtaccagttgtgttgaagagtgtgactgatatggtggataaatggtccgataagttatcagaaaacggtgaagttgaggtagatgtctatgagtggtttcagattttgactgaagatgttattagtagaacagcttttggaagtagctatgaagatggtcgagcagtttttcgacttcaagctcaacaaatgcttctttgtgctgaagcttttcaaaaagtcttcattcctggctatagattttttccgacaagagggaatttgaagtcttggaagttagacaaggagataaggaagtcgttgttgaagctgatagagcggcggagacaaaacgctatagatggagaaggggaagaatgtaaggagccggcggcgaaggatttgttgggattaatgattcaggcaaagaatgtgacggttcaggacattgtggaggagtgtaaaagctttttcttcgccgggaaacagacaacttctaatctgctgacgtggacgaccatcttgctatccatgcacccggagtggcaggccaaagcacgtgatgaggtcctcagggtctgcggctcacgtgatgtccctaccaaggaccatgtcgttaagcttaaaacgttgagtatgatcttgaacgagtctttaaggttgtatccaccaatagtagctacgattcgacgcgctaaatcggatgtgaagctaggagggtacaaaatcccatgtggcacggagcttctaatcccaatcatagcggtccatcatgaccaagccatttggggtaatgacgtgaacgaattcaatccagctcggtttgcggatggagtgccgcgtgctgccaaacaccccgttggcttcataccgtttggcctcggagttcgtacatgcattggtcagaatcttgctatacttcaggccaaattgacactcgctgtaatgatccaacgcttcacctttcacttggctcctacttatcagcatgcacctaccgtccttatgttgctttatcctcaacatggtgcaccaatcaccttccggagattgaccaatcatgaggattgatgaaagatcttcaacggtcaaaaatttgttccggacttggaagaaaaatgtctcaagctttcataactgacatgctctttttgttgtcttttttttttttaactttcataaatatatagttttaactttcaaaccattgttttttttttcattccatttttctctaaaatttatttttatcagcttcaatttggggttt

SEQ ID NO: 860 - DNA, 7526 bp, Arabidopsis thaliana
tttttcttttttctttttttcttttgcagaaattgaagatcacctttgtcggtctggagcttgtcgactcaaaatctggtaattcacgctggattttggatttcagagacatgggttccccagcaatcattcttctctctgatgcataccggacaaaatctgcggactctgctgggtttgttctgtgtcccatgtatgggagaaagtcaaaagcttttagagctgcacccgggacaacaaattcctccattgtcgcaagtttggctaagactgcaaagtccatggttggggtattcttgtcagtcgatgattcacaattgctgacagtatcagagtatatgacacgaagggctaaagaagcagttggagctgaagaaactcctaatgggtggtggtctgttactagattaagatctgctgctcatggaactctgaacatgcctggactaagcttagcaattggccccaaaggaggacttggtgagcatggggatgctgtagcccttcagcttattcttactaaggcctcccttgttgagagacgaatagataactatgaaatgtgtgcaggttgttatcgttcgtcctctatcttcagtaagttcacttgtccggttcgctgaggaaccccaaatgtttgctatcgaattcagtgatggatgtccagttcttgtctacgcgagcatatcccgagacaacctacttgcagctattctcgatactttgcaaacagaaggacactgcccgataccagtattaccaaggcttactatgcctggtcatcgcattgatccaccttgtggaagggttagtttgatctctggaccacaacatcttgttgctgatttggaaacttgctccctacatctgaaacatttagctgctgctgcaaaagatgcagttgccgaaggtggttctgttcctggttgtagggctagattatggcgcagaataagggagttcaatgcttgtatcccgtatacaggtgtgcccgctaatagtgaagtccctgaggtgactttgatggcattaattacaatgctaccatcaactccaaatctccctgtagacgcccctcctttgccacctccttcacccaaagcagcagcaactgtcattggctttgttacatgtttgcgtaggttattgtcatccaggagtgcagcatcccatataatgtcattccctgctgctgttaacaggataatgggtttacttaggaacggttctgaaggtgtagctgctgaagctgcggggcttattgcgtccctcataggcggttggtcagcagatctgagcactgcaccagattccagaggagaaaaacatgcaactatcatgcataccaagtctgttttgtttgctcaacagggttatgttactattctggtcaatcgattgaaacccatgtcagtctcacctctgttttccatggcgattgttgaagtctttgaggctatggtttgtgatccacacggagagactacccaatacactgtttttgtagaattgttacgacagatagctgccctacgacgtcgtttatttgcactctttgcacatcctgcagagagtgttagggaaaccattgctgttatcatgcgtacaatagctgaagaagatgcaattgctgcagagtcaatgcgtgatgctgctttgcgcgatggtgctttgttgagacatttattgaatgcattttcccttcctgccagtgagcggcgcgaggtaagtaggcagcttgtggcactctgggcagattcttaccaaccagctttggatctactgtctcgagttctgcctcctgggcttgttgcatatttgcatacacgtcccgatgatgttgtcgatgatacagatcaagaaggttcttcaacaaataggcggcagaaaagattacttcagcagagaagaggtcgcatagctaagggaatgggtgctcaagatattcctcttccccctggtaataatgttgaggctggcgatgcagcaaaacatatgagtgcaaatgctagtgtacccgataactttcaaaggcgggcagcagattcttcctctgaagcttccaatcctcaggcttctgcttttccaggtgttgacagtactattgcaggggtttcacaaaatggctatccagcatttgcttcagtcaccacaaatgcaaatgggcatgagcaacctgagactaatgcatccgatgtggttggttctgacccaaacttgtatggcatccagaattcagtgcttccagcacctgctcaagttattgtagaaagtacagctgtaggatccggaaagctacttctaaattggcgtgagttttggcgagcctttggccttgatcataatcgtgcagatctcatctggaatgagcgtacaaggcaagaattaatagaagctttgaaggctgaagtccacaacctagatgtcgagaaagagcgcacagaagatatttcccctggtgatgtcgaggccacaactggccaggagattatcccacgtatatcttggaactattctgaattctctgtcagttatcgtagcttatcaaaagaagtttgtgtgggccagtattacctacgcttattgcttgaaagtggcaacgctggcaaggcacaagatttccctctccgtgatccagttgcttttttcagggcactctatcatcgtttccagtgtgatgctgatatggggcttactattgatggtgctgttccagatgaattgggttcatcaggcgactggtgtgatatgagtaggcttgatggttttggtggagggggaggagcttctgttagggagctttgtgcaagagcaatggcgattgtctatgagcaacactacaacacaataggtccttttgaaggcactgcacatattacagcactgattgataggacgaatgatagagctttgaggcatcgcctactacttctcctaaaggccctagttaaggtcttgttaaacgtcgaaggttgtgttgtggttggtggttgtgtcctagctgtagatctgctgactgttgttcatgaaaactcggagaggactcctattccattacagtccaatttaattgctgctactgcatttatggaaccacctaaggaatggatgtacatagacaaaggtggtgcagaagtgggacctgtagagaaggacgtcatcagaagtttatggtccaaaaaggatattgactggacgacaaagtgtcgggctttaggaatgtcagactggaagaaattgcgtgatatccgtgaacttagatgggcagtagctgttcgagttccagtcctcacacctagtcaggtaggggatgctgcattgtccatattacatagcatggtttcggcacattcagatttggatgacgctggagagattgtaactccaacaccaagagtaaaacgtatcttgtctagtacacgttgtcttcctcacattgctcaggctttgctatctggcgaaccagttattgtggaggctggtgctgctctcttgaaagacgttgttaccagaaactctaaggcaatgatccgactgtacagtacaggggccttttactttgcccttgcttaccctggatctaatctttactcaatcgcacaactcttctcggtcacccatgtccatcaagctttccatggtggggaagaagctactgtttcctcctctctgcccctggctaaacgaagcgtattgggtggtcttctcccagagtccttactatatgtattagagcgcagtggaccagctgcgtttgcagctggcatggtttctgattccgatacgccggagattatatggacacataaaatgcgagcagaaaatcttatatgtcaggttttgcagcatcttggtgattatcctcagaaattgtcacagcactgccattctctctatgattatgctcccatgccacctgttacgtatccagaacttagagatgagatgtggtgtcaccgttattatctcagaaatttatgtgatgagattcaatttcctaattggccgattgttgaacatgttgagttcttacaatcattacttgtgatgtggcgtgaagagttgactaggaaacccatggatctttctgaaggagaagcttgcaaaattctagaaatatccctgaacaatgtatcaagtgatgacctaaaccggactgcttcagttgagttgaatgaggaaatatctaatatatccaaacaaattcaaaaccttgatgaagagaaactaaagcgccagtataggaagcttgcaatgaggtaccatcctgacaagaatccagaaggaagagaaaagttcctggctgttcaaaaagcttatgaatgcctacaggcaacaatgcaaggattgcaaggtcctcagccgtggaggttgctgcttttactgaaagcgcagtgcatcttatatcgccgttatggacatgtgttacgaccgttcaaatatgctggctatccgatgttacttgatgcagttacagtggacaaggatgacaacaactttctatctaatgatagatcccctcttcttgttgcagcatctgagcttgtttcgttaacctgtgctgcctcgtcattgaatggtgaagaattagtgagagatggtggtgtgcagcttctatcaactcttctttcccgctgcatgtgtgtggttcagccaacaacttcacaacacgaaccagctgcgatcattgtcacaaatgtaatgcgtacactttcggtaataagtcagtttgagagtgcgagggctggatttctagagttacccagtctgattgaagacattgtgcactgtacggaattagaacgtgtgcctgcagccgttgatgctgctctccagtccattgccaaggtttctgtcttccccgaacttcagcatggtctgctaaaggctggtgccttatggtatattctcccattattactacagtatgactcaactgctgaggaatctaattctgtcgagtctcatggggttggagttagcattcaaattgccaagaatgagcatgccttacaagcatcacaagccctatcaaggcttactgggctgtgtgcagatgagagtttgacaccttacaatgctactgcggctgatgttctcaaagcattactgacgccaaaacttgctagtttgttgaaagatgaagttgccaaggatttgttatccaaactgaacacaaatttggagacaccagagattatctggaactctgcaactcgatcagagcttttaaattttgtggatgaacaacgcgcctgccagtgccctgatggttcatatgatctgaaaaatgctcaatctttttcgtatgacgcactgtcaaaagaggtctttgttggcaatgtttacttgaaggtctataatgatcaacccgactcagagatcagtgaaccagaatcattctgcaatgccctaatcgactttatatcatcattagtgcatactgagttgccctctgtttccgaggaccaaaatttgatcgaagacagaaactcatctaatgatactccagagcttcaaagtagcgtcgcagaaccgtcgttgattgaagaacattccgatcatcagccatcatctgaggggatgaagaacgaagaatgttttctgattgatcacctccaattaggattgactgctcttcagaacttgcttacaaagtatccagatctggcttcagtgttttcgtctaaggagagattgttacctctctttgaatgtttttctgtggccattgcatcaaaaacagatattccaaaactctgcctcaatgtcctctctcggttaacagcttatgctccttgcttggagacgatggtatctgatggatctagtcttcttctcctcttacaaatgcttcattctgcaccttcttttcgcgagggtgctctccatgttctttatgctttggcaagcacaccagaacttgcttgggctgctgcaaaacatggtggagtagtatacattctggaacttttattgcctttgcaaaaagaaattcccttgcagcaaagagctgcagcggcttctttgttggggaagctcgtcgcacaaccaatgcatgggcctagagttgctatcacacttgtgagattccttcctgacggtcttgtatctataattcgtgatggacctggggaggctgttgtccatgcacttgagcggaccactgagactccagaacttgtgtggacaccagcaatggcagcatctttatccgcacagattgcaaccatggcatcagatatttatcgtgaacaacagaagggttctgttattgaatgggatgtaccagagcagtcagctggtcaacaagaaatgagagacgagccacaggttggtggaatctatgtcaggcgtttcttaaaagatccaaaatttcctctgagaaatccaaaacgattcttggaaggactgctggatcagtatttgtcagcaatggccgcaacacattacgaacaacatcctgttgaccctgagctccctctccttctctctgctgcattggtttctttgttgcgtgtgcatcctgcacttgcagatcacattggacatcttgggtatgtcccaaaacttgtcgctgctgtggcatatgaggggaggcgggaaacaatgtcttctggcgaagtgaaggctgaagaaattggctctgatggagtgaatgagtctactgatccctcaagtctacctgggcaaacccctcaagaacgtgtgcgccttagttgtttacgtgtgcttcatcaacttgcagctagtaccacatgtgctgaagcaatggctgcaactagtgctggaaatgcacaggtggttccacttctcatgaaagcaataggatggcttggtggaagcattttagcactcgagacacttaagcgtgttgttgttgctggaaatcgggccagagatgcgcttgttgcgcagggtctaaaggttggtctcattgaggttcttcttgggctgcttgactggaggacggggggtaggtatgggctcagttctcacatgaaatggaatgaatcggaagcatcaatcgggcgggtacttgcagttgaggtattgcatggttttgcaacagaaggagcacattgctcaaaagtgcgtgagatacttgacgcgtcagaagtgtggagtgcatataaagaccaaaagcatgacttgttcctgccatcaaacacacaatcagcggcaggggtggctggctttattgagaactcatccaacagtctcacttacgctcttaccgctcctcctccgccttcgcatccttgaccatttcttccttgtatatccttttgtaaagtccaatcattaccgtgcttttttttttctttctatagagaaatactgtcgtttgtaaatgtttgatgagaaagtagaaaatatttgtggtttccttggaccaacaatgaaaactacggtctgatgacaggatttgtagttgttgggtcgtagacgatatccaaacaacttgtccctttatattttgggattaaacttgttgcttattaagtcaattttctccattatct

SEQ ID NO: 861 - DNA, 3064 bp, Arabidopsis thaliana
ctccttcctctcctctctcgccattgccctctggcgttttctgtcttgagctaaagaaataacaaataaaccgaaaaaaataaaaatagaaacttttttttttgtttatttgttctttctccaaaactccttttttttctcaccattatctcatgaacgtgagtggaggctctctgagtagagagagcctacccttgaaaataacctagggatttctccaattttcaagctttacccattcaaaagaatcgtccttttttcctatttctgactttgagctatgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttgaagaataataagaaataagaagaccagattttactccatttttcccttggtagggaggttatttatgtaagatattaaagttaggtgccactatgctccaaagtcttttgaaattcgaggaccaatatgtaatatgacgaatgtctgatcttgtatggattgttcttgttcctatgttacgttatatggcaagattattatgataatgttatcaagttttttttct

SEQ ID NO: 862 - DNA, 2135 bp, Arabidopsis thaliana
gaagcatcttatagtatttttagcttcattccttcttttgctctgatcaaagtcttctccttcccttctctctctctttcctcctctgcacatttctgggttcttctcttcttatgctctgtttcttttaagacacagaagaaacagtacagagttgagattttcttaaacaaaagtgaaaagagaagaaacaagtgacagctcaaacggacaaaaaccactcttgggtctttcttgcttctgattctttctcttctctaatagaagaaaacatctagaagctaaaaaaatgtcggaaggagtagaagcgatagtagcaaatgacaacggaacagatcaggtaaacggaaaccgtaccgggaaagataacgaagaacacgacggctccaccggttctaacctaagcaatttcctatggcacggtggctctgtctgggacgcttggttcagctgcgcatctaaccaagtggctcaagtgttattgacattaccgtactcgtttagtcaactaggaatgttatcaggaatagtacttcagatcttctatggtttactaggaagctggactgcttatctcatctctgttctctacgtcgaatacagagctcgtaaagaaaaagaaggcaaaagcttcaaaaaccacgtcattcagtggtttgaagtacttgatggattacttggttcatactggaaagcactaggactcgcatttaattgcactttcctcttgtttggatctgttatccaactcattgcttgtgccagtaacatttattacataaacgatcatctggacaagagaacatggacttacatatttggcgcgtgttgtgcaaccactgtctttataccgtcgtttcacaattaccgaatttggtcattccttggccttggaatgaccacttacaccgcttggtacttagccattgcctccatcatccacggccaggcggaaggtgtgaaacattcaggtccaacaaagctagtgctttattttacgggagccacaaatattttgtacacctttggaggtcacgcggttactgttgagattatgcatgctatgtggaaaccacagaagtttaagtacatttacttgatggcgacgttatacgtgttcacgctaacgattccgtcagctgccgccgtttactgggctttcggagacgcacttctcgaccactccaacgctttctctcttatgcccaagaacgcgtggcgtgacgccgctgttatcctcatgctcattcatcagtttataacgttcgggttcgcttgtacacctttgtactttgtgtgggagaaagtgattgggatgcatgacacaaagagcatttgcttaagggctttggctagattgcctgtggtcatacctatttggttcttagctattatcttcccctttttcggtccaatcaattccgctgtcggtgctcttcttgttagcttcaccgtctatatcatcccatctctcgctcacatgctcacttaccgatctgcctccgctcgtcagaatgcggcggagaagccaccgttctttatgccgagctggacggcgatgtacgtgttgaatgctttcgtggtggtttgggttcttatagtcggatttgggttcggtggatgggctagtgtaaccaactttgttcgtcaagtcgacacttttggtctctttgccaagtgttaccaatgtaaaccagctgcagccgccgcacatgccccggtctccgctttacaccaccgtctttgagagatcgagtcagggttcttctaatgcgtttgtggagggttcttaaaattatttgttcttcttttgtgttttgtgttcgtatacgtgaagggagtaaaagtcacgaaaatagtgtactttttacacacccctttaaatgcgtgctaagctcttaattatttttttctcttttggggttttgtatttttgttttcactccttagttttttttttaaaattgaatagtcgataatatgtagtgtgtgatttcttaatttggtattgttaaaacaataggctaagaaaatgtatcgtcttctctccttttacttgtctttagtaacaaaaaacaattcttatcttatacatttatcctaattagacttatataaactattttaccatgaac

SEQ ID NO: 863 - DNA, 2983 bp, Arabidopsis thaliana
tcagatcactgtttctgtttccatttcaagacctcagaatccaaagcttttgtgggcattcagctgatttttaaaaaaatccgaatttgatactatcaggtgcttgtttgcgttttaatgttcagagattgagcttcagatgatgcttggattctgcataacgcgtcgaatctttgtaggctttataagaatttcgcctcttgttaagtgttgtggtgctggaaattgcggaaactctttagaggtttatgatgagattgtgcctccaaggtgtttgtagtattgcctgagtgatgggaaacgggacttcccgtgttgttggttgtttcgtgccgtctaatgacaaaaacggtgttgatttggagtttctggaacctttagatgaaggtttaggccattccttttgctacgttaggccaagcatctttgagtctcctgatattactccgtctaactcggagaggttcaccattgattcaagcactattgattctgagacactcactgggtcttttcgaaacgatatcgttgatgatccttctttcttgaatagacacaacagtaaaggtttggcggaaactacgtttaaggcaatctcaggtgcttcggttagtgccaatgtttccacggctaggactgggaatcaaatggcattgtgttcaagtgacgttttggagcctgctgcttcatttgagagcacttcctcgtttgcttctattcctttgcagccgctccctcgtggtggttcgggacccttaaacggattcatgtccgggcctctagagagaggttttgcatctggtcctttggatagaaacaacggtttcatgtctgggcctattgaaaaaggagtaatgtctggaccccttgatgtatctgatagatctaatttctctgcgcctctttcttttagacgtaaaaagcctcggtttcagcgttttatgaggagtgtgagcggaccaatgaaaagtacattagcaaggacattttctagacgatctggagggttaagttggatgcatcgcttcttcttgcatccagagactagggtttcctgggctgttggaaaggacggtaagctacatggtgaagaccctgaaagttgtctagagagcaaccgtaacttgcaatgggctcatgggaaagctggagaagatagggttcacgttgtgctttcggaggaacaaggatggctctttatcgggatatatgatgggtttagtggaccggatgctccagatttcgtaatgagtcatctttataaagctattgacaaggaattggaaggtcttctttgggattatgaagagccatctgaagataatcaattgcagcctgaccaggaacctcctacagaagagaacatgtgtgatccagaatctatcagtgagcagcattcaaagtcagtagtggcagaaagtgaggaggttatgattgatgatatcagtagccttggaaataccgatactcagattgctgatggtccacctggagactcagctggtcctggcaagaaaagcatgagactttacgagctacttcaattggaacagtgggaaggagaagaaatcgggcttaaacgatatggagggaatgtcgctctaaacaatatgaccaatcaggttgaaaatccatctacttcaggtggaggagctggaaatgatccttgtaccaccgaccgtagtgctcttgatgggattccgaactcgggacaaaggcatgggactaaaaaatcacagataagctctaagataagaagaatgtatcaaaaacagaagtctttgcggaaaaaactgtttccatggagttatgattggcacagggaagaagggatttgcgttgaagagaagatagtggagtcatcgggaccgattaggagacgctggtcagggactgtggaccatgatgctgttctaagagcaatggctagagcactagagagtactgaagaggcgtacatggatatggtagagaagtctcttgacataaacccagagctcgcgctaatgggttcatgtgttcttgtaatgctaatgaaagatcaagatgtttacgtgatgaacgttggggatagtcgggctatcttagcccaagaaaggctccatgatcgtcactctaatcctggttttgggaatgatgagggtatcgggcataagagtaggtctcgagaatcacttgtgcgtattgaactggatagaatatcagaggaatctccaatacacaatcaagcaactccaatcagtgtgtcaaacaaaaacagagatgtgacctcttaccggttaaagatgagagcagttcaactatcaagtgaccatagcacaagtgtggaagaggaaatttggcggattagatctgaacatccggaagatgaccagtcgatacttaaagatagagtcaaaggccaactaaaagtcactcgagctttcggtgctggatttctcaaaaagccaaatttcaatgaagctttgcttgagatgttccaagtagagtacattggaacagacccgtacatcacatgcgaaccgtgtaccgtccatcacagactgacttcaagcgatcgtttcatggttttatcctcggatggattgtatgaatacttcagcaacgaagaggttgttgctcacgtgacttggttcatcgaaaacgttcctgaaggcgatcctgctcaatacctcattgcagagcttctctctcgtgctgccaccaagaacggaatggagtttcatgatctgttggatattcctcaaggagatagaaggaagtaccatgatgatgtctctgtcatggttgtgtcacttgaaggaaggatttggcgctcgtctggacaatattatccagagagaaaacaaaaattcaatagataaattaaccaaacacaaaaaaaaaaaaattaggttttggcttattgttttcaaacaatctttcaatttcccggaagttcaaaaaaagaaggcctaattctgtttttccttcttcccaatcc

SEQ ID NO: 864 - DNA, 1740 bp, Arabidopsis thaliana
acattagcttcctcatttttattcttattattattattcatcagaccaacaacaaaaaggagataaagagaagaggattcatcatcatcaatcaatccttcattttatggatctactcatatcttgattcttccttctatctctcccttttcttccatctctttttctctgggtttccccggattgagttttttaatctctgattgacagatttgaagagcgtgacaaaggaagaatcttttattaaaacaaattcttctgttttaatcttgggatggcctcggtgggcatagagcctagtgccgcggttagagaatctactggaaacgttactgatgctgatagattacccgaggagatgaaggacatgaaaattcaagatgataaagaaatggaagctacgattgttaatggcaatgtgactgagactggccatataatagtaactactataggaggaagaaatggccagccaaaacagacaatcagttacatggcggagcgagttgttggacatggctcctttggtgttgtgtttcaggccaaatgtttagaaacaggagaaactgttgctataaagaaagttctacaagatcggaggtacaagaatcgtgagcttcaaacaatgaggctacttgaccatccaaatgttgtgtctttgaaacattgtttcttctctacaaccgaaaaagatgagctttatctcaacttggttctggaatacgttccggaaactgtgcaccgcgtcatcaaacactacaacaaacttaaccaacgaatgcctctcgtttacgtcaaactttacacttatcagatttttaggtccttatcctacattcaccgatgtatcggcgtatgtcatcgagacatcaaacctcaaaacttgttggtaaatccacacactcatcaagtgaaactatgcgattttggaagtgcgaaagtattggttaaaggagagccaaacatttcatacatttgctcgaggtattacagagcacctgagctcatttttggagccaccgagtatactacagccattgatgtctggtctgcaggatgtgttctcgccgagcttcttctcgggcagccattgttcccgggtgagagcggtgttgatcaacttgtagagattataaaggttttgggaacaccaacaagggaagaaatcaaatgcatgaacccgaattacacagagttcaaatttcctcagattaaagctcatccatggcataagattttccacaagagaatgcctccagaagctgttgatttggtctcaaggcttcttcaatactctcccaatctccgttgtgctgctcttgattcattggtccacccattctttgacgagctaagagatccgaatgcgcgattacccaacggacgtttccttccaccgctctttaactttaagcctcatgaacttaaaggtgtgcctgtggagatggtggcgaagttagttccagaacatgcgaggaagcaatgtccgtggctcagtttgtgatttgttctcacctgcaaacacgaaaactagagcaaagcagtcgagatattcatctcttctcttctctctccttctctgtattaatattattataatgatcatatctcaatctgatgatttagtaaccctttgtttgttgtatgagtagagaaagagtgaatcatttgtgggggttatgatattgtataagccaacaaagattattttttaaagagagtttcgtgttttctgtctca

SEQ ID NO: 865 - DNA, 2910 bp, Arabidopsis thaliana
tatttcttttgtcaaattagagagaagctcttatgaccttaggagaagcagtcgtcaaagcaccggtgcatcaataacgagctcgagcctagagatctctgtcccattctcttcgtcattcatcactctatctgcgtttcgttgagcgataatggatgccgcttgctctacccagcttatcgatggggatggtgtctttaatgtttctggggttgatcatttcatcaaggaggttaaattggacgaatgtggtctttcatacgcggttgtctcgattatgggtccacaaagtagtgggaagagtacgctcttgaatcatttgtttggaaccaactttagagaaatggatgcatttagaggaaggtctcagacgactaagggaatttggattgctagatgcgctggtattgagccttgcaccgttgtgatggatttagagggtaccgatgggagagagcgtggtgaggatgatactgctttcgagaaacagagtgctctttttgcacttgcagtctcagacatagttcttataaacatgtggtgtcatgatattggtcgggaacaagcagcaaataaacctcttttaaagactgtgttccaggttatgatgcggttgtttagtccgcggaagacaactttgatgtttgttataagagataaaacacggacgccactggaaaatttagaaccagtgctgagggaagacattcaaaagatatgggattcagttcccaagcctcaggcccacaaagaaactccacttagcgatttcttcaatgttgaagtagttgctctctcgagttatgaagaaaaagaagagcaattcaaagagcaggtctacaatttgagacaacggttcttccaatctgtcgcacctggcgggcttgctggtgatcgacgaggagttgtccctgccaatgcttttgcttttagtgcaaaacagatgtggcaagtcatcaaagacaacaaagacttggatcttccagcacacaaggtcatggtagcaactgtgcgatgtgaggaaattgccaatgaaaaattctctagttttatcgcgaatgagaattggcgcgagttggaagaggctgtacagtctggtcctgtttccggatttggaagaaagctgagctcaattctccaagcaagcttatcagagtatgacacagaagcgacatactttgaagaaagtgttagatcatccaagaggcaacagctgcaagaaaagttattgcaacttgttcaaccaactttccaagacgtgcttggacatttgagggctggagcacttgaaaacttcaagaatgcttttgagaaggccttggatgctggagaagggttttcatcatctgcgaaatcctgcgctcagtcatgcatatctaagtttgataaaggatgtgaagaggctgttattgaacaagcaaaatgggatacatctaaaactcgggaaaagcttgagcgtgatattgaagctcatatctcttctgtccgtactgcaaagttggctgaactgactactctgtatgagtcaaaactaaatgtagccttatctggaccggtggaagctcttctggatggggctaatgatgaaacatggccagcaataagaaagctacttagacgggaaggagaattggctgtctatggtctctccaacgcattatctggtttcgaaatggacgaagaaacacggagtaaaatgcttgctgatctcgagaactatgcacgaggtattgttgaaaccaaggcaaaggaagaggctggaagagcgatgatgcgcatgaaggatagatttgctacaatcttcagccatgattctgattcaatgccacgtgtttggactggaaaggaggacatcagagcaattacaaaaatggctcgttctgcgtccttgaagctgctgtctgttatggctgttatacgcttggatgatgaactcgacaatattgagaagacattgacgctagctctgtttaattctacgggcaacaatgctactagcaagagcatcagcacaattgattcacttgcctcaagcacttgggagaaggttgcaccagaaaagacgttgatcacacctgtgcagtgtaaatcactgtggaggcaatttaagaacgagacagaatataccgttacacaggccatttctgcacaggaagctaaccgacggaataacaactggctgccacctccatgggcaatccttgccctggttgttcttggatttaatgaatttatgactctcttaagaaatcctctatggctcttagttctatttgtcggataccttgtatccaaagccttgtgggtgcaattaaatatttcaggagaattccaaaacggcgtgctacctggacttctctctttgtcaaccaaattcattccaacggtcatgaacctcctcaaaaagcttgcggaagaaggacaagcaccacccacaaatagcaaccaatcaatgaactctacagctcaatccgaggttacaaccaatggagaaagcagcagcagcagtagctctggttcatctccagcaaaaaacgtacccattgatacaagtgcatagaacaaagaagtatacaagcttaagctgttgtgctagcccacgaagctagaaacttaaaattcgttaccctttcaaaaaggtagctctcagttttggtgttgatcagagagattcaccgagagccatatgttttatgtctccgatggcattggttccctcttgcaggtgtcaaagtgatcttgtatgttcctagactaagattctgatgcagacaaaaacaaaaaaactcatgatttgtttgcgagttctgtagtgatgtggttattgtatctgataaaaagaatgttacttgaagaaaaaccggtttttgattaagtgaaattcagtttggtttttgttgattgaagaga

SEQ ID NO: 866 - DNA, 974 bp, Arabidopsis thaliana
atttttagagctttcttcttgtgccgacaatggatgttgatgtgtttaacggttgggggaggccaagatttgaagatgaatcccttatgccacctgggtttaggtttcatccaactgatgaagagctgatcacttactatctcctcaagaaggttcttgactctaatttctcttgtgccgccatttctcaagttgatctcaacaagtctgagccttgggagcttcctgagaaagcgaaaatgggggagaaggagtggtacttcttcacactaagagaccgtaaatacccaacgggactgagaacgaacagagcaacagaagctggttactggaaagccactggtaaagacagagagatcaaaagctcaaagacaaaatcacttctcgggatgaagaaaactcttgtcttttacaaaggcagagctcctaaaggagagaagagttgttgggtcatgcatgagtatcgccttgacggcaaattctcttaccattacatttcctcctccgctaaggatgaatgggttctctgtaaagtttgtctgaaaagcggcgtagttagtagagagacgaacttgatctcttcttcttcttcttctgccgtcaccggagagttctcctctgccggttctgcaattgctccgatcatcaatacctttgcgacggagcacgtgtcctgtttctccaataactctgctgctcataccgatgcgagctttcatacattccttcccgctccaccgccgtcactgcccccacgtcagccacgtcacgtcggtgatggcgtggcgtttggtcagtttctggatttgggatcatcgggacagattgatttcgatgcagcagcagcagcgttctttccgaatctaccttctctgcctcccacggttcttcctcctcctccgtcatttgcaatgtacggtggaggctcccccgccgtgagtgtgtggccgtttactctctgatcgccatgcggt

SEQ ID NO: 867 - DNA, 4260 bp, Arabidopsis thaliana
gactggagaaaatgagaaaatcaaaatcactgagaaagaaatttcgagaaatctgaaaatcggaaggaagaaaacaaaaacctttcaattgaagaacggagaaatcatcatccgatgggtcgattagatgtagctgcggcgaagagagcgtaccggaaagcagaagaagtgggtgaccggagagaacaggcgaggtgggctaacaatgtcggcgatatccttaagaatcatggagagtacgttgatgctctcaagtggtttaggattgattacgatatctccgtcaagtatttacctgggaaagatttgttacctacttgtcagtctcttggcgagatctatctccgcctcgaaaatttcgaagaagccttgatttatcagaagaagcatttacagctagctgaagaagctaatgacactgtggagaagcaaagagcatgtactcaacttggacgtacttaccatgaaatgttcttgaagtctgaggatgattgtgaagccattcagagtgctaaaaagtactttaagaaagccatggaacttgcacagattctcaaggagaaaccacctcctggagaatctagcggattccttgaggagtatattaacgcacataacaacatcggtatgcttgaccttgatcttgataatcctgaagcagcccgtactattcttaagaaagggctgcagatttgcgatgaagaggaggtgagagagtatgatgctgctcggagtaggcttcatcataaccttggaaacgtttttatggcgctgagaagttgggatgaagcaaagaaacacattgagatggatattaatatctgtcataagattaatcatgtccaaggagaagcgaaggggtatatcaatctcgctgaattacacaacaagacccaaaagtacattgatgctcttttatgttatggtaaagcttctagtctagcgaaatctatgcaagacgagagtgcattggttgaacagatagagcataataccaagatagtcaagaaatccatgaaagttatggaagaattgagagaagaagagcttatgcttaagaagttgtctgcagaaatgactgatgccaaaggcacttcggaggaacgaaagtctatgctccaagtaaatgcttgtcttggaagtcttattgataaatctagcatggtattcgcatggctgaagcatcttcaatattcaaaaaggaagaagaaaatatcagatgaactctgtgacaaggaaaagctgagtgatgccttcatgattgttggagaatcttaccaaaatctcagaaatttcagaaagtccctgaagtggttcataagaagttatgagggacatgaagcaattggtaatctggagggtcaagcactagcgaagattaatattggtaatggtttggactgtattggggaatggacaggagcacttcaggcatatgaagaggggtacagaattgctttgaaagctaatcttccttcaatccagctttctgcactggaagatatacactatatccatatgatgagatttgggaatgctcaaaaagccagtgaattgaaggaaacaatacaaaatctgaaggagtcagaacatgctgagaaagccgaatgtagtacacaagatgaatgctctgaaactgactcagaagggcatgcgaatgtatcgaatgataggccaaatgcatgtagctcaccgcaaacaccaaattcacttagatcagaacggttagcagatctggatgaagcaaatgatgatgtgccactaatttcatttctccagcctggaaaacgtctgttcaaaaggaaacaagtttcaggaaaacaagatgctgacactgatcagacgaagaaagatttctctgtagtagcagactctcagcagacagttgctggtcgaaagcgtattcgagtaatcctctctgatgatgaaagtgagaccgaatatgagctgggatgccctaaagacagttctcacaaagttctaaggcagaatgaagaggtttctgaggaaagtatgtattttgatggtgctattaattatacggataatcgtgccatccaagataatgtagaagaaggttcttgctcgtatacgcctctccatcctattaaggtggctccaaatgtcagcaattgtagatctttgagtaataatatagctgttgaaacaactggtcgtcgtaaaaaaggatctcaatgtgatgttggcgactccaacggcacgtcctgcaaaactggagctgctctcgtgaacttccacgcttactcaaaaactgaggatcgaaaaataaaaattgaaattgaaaatgaacacatagctttagactcctgttctcacgatgatgagtctgtgaaggtggaacttacttgcctatactatttacagcttcctgacgatgagaaatctaaaggtctgttgccgatcattcatcatttggaatatggtggaagagttctgaaaccattggaactatatgcgattctcagggactcttctgaaaatgttgttattgaagcttccgttgatggctgggttcacaagcgcctgatgaaactatacatggactgttgccagtcgttgtcagagaaacccagtatgaaattgcttaagaaattatatatttcggaggtagaagatgatatcaatgtgtcagaatgtgaactgcaagacatatcagctgctccattattgtgtgccctccatgtccacaatattgctatgttggatctctcccacaatatgctagggaatggaacaatggagaaattgaaacaactttttgcctcatcaagccagatgtatggtgctttaactttggatttgcactgcaatcgatttggtccaactgctttgtttcagatctgtgaatgccctgttctgttcactcgacttgaagtcctcaatgtgtccaggaatcgacttacagatgcttgtggatcatacctctcaactatagtgaaaaattgccgggcactttacagcttgaatgtggaacattgttcacttacatcaagaacaatccaaaaggtagctaatgctttggattcgaagtcaggactttcacaactctgtataggttataataatcctgtttcagggagtagtattcaaaacctcttggctaaattggctactctaagcagctttgcagaactgagcatgaatggcataaagctgagcagccaagttgttgatagcctttatgcacttgttaagactccatctctgtcaaaacttttggttggcagcagtggaataggaacggacggggctataaaagttactgaatctctatgttatcagaaggaagaaactgtgaagctcgacctttcatgttgtggactagcttcctctttctttattaagctcaaccaagatgttactctaacctctagcattcttgagtttaatgttggaggaaatccaatcaccgaagagggaatcagtgcacttggggagctgcttaggaatccttgttcaaacataaaagttcttattctaagcaagtgtcatctgaagctcgctgggcttctatgcataattcaagcactttcagataataagaatcttgaagagcttaatctttctgacaatgctaagatagaagatgagactgtgtttggccaacctgtgaaggaaagatcagtaatggtagagcaagaacatggaacatgtaaatctgtcacctcaatggacaaagaacaagagctatgtgaaaccaatatggagtgtgatgatctcgaagttgcagacagcgaagatgaacaaatagaggaaggaactgcaacctcgagtagtcttagtttgccacgcaagaaccatatcgtgaaagagctttctaccgctctttcaatggctaaccagttgaagattctggacttaagcaacaatgggttctcagttgaagccttggaaacattatacatgtcatggtcatcatcaagctcccgaactggcatcgcccaaaggcatgtaaaagaagagactgtccatttttatgtcgaaggaaagatgtgttgcggagtcaaatcatgctgcagaaaggactgaagaagatcttgtctgaaactgtatttgccaataataaacctctgtttttaaatattgagtatttttatttagagcgtttgcagaaatttttacatattgatatttacacatttgggttgtgatgtgtaaatttgctgcagtttaagcgttaatgctcatataaatttagtgacgttaatcttatgcaactttttaaaaaatgtaaaaatt

SEQ ID NO: 868 - DNA, 1258 bp, Arabidopsis thaliana
tatattattattgccccttcctctcctttcttcttcccctcttaccttttcagagagagaaacaatatttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttgaattaataataaaaaaaaagaagcatcaatgatcaacaatatgacgggttcttgattttatatgtatttttatgattgtatgtggctatcacctatatatgtgtgttgtaattttaaatacttgatgggtatatagggcagtattttaccagtaagatgtggacaaacttgtaatgtgaccaaaagagaggaaacttcaatatctctgtgtttgtgtcatatttattgcccaacatgtgtctgtcggtttgatgatcaatcacaacttgatatgtgcatacatataaatgtgtgtatgtaggtgtgtgtacatgtacatgtgttttgatccctactctgctacttgtcgtttcttgtgtgtgttatctaatagttttttcccaaaatgaataattcgttgttatgtttactattttaccaataaaatcttagcttttt

SEQ ID NO: 869 - DNA, 1419 bp, Arabidopsis thaliana
atggcgaacgtaatctcaatttcccattttacccttctcgcattaccttatttacttctcctcctatcttccaccgccgccgcaattaacgtcaccgccgtcctctcctctttccctaatctctcatctttctcaaacctcctcgtctcttccggcatcgctgccgaactctccggtagaaactcattaaccctcctcgccgttcccaattctcaattctcctccgcctccttggacctcacgcgccgcctacctccttccgccctagcagatctcctccgcttccatgtcctcctccagttcctttcagattccgatctccgacgtattccaccgtcaggctccgccgtcactactctctacgaagcttccggtcgtacattctttggatctggatccgttaacgtaacccgtgacccggcttcaggatccgtcacgatcggatctccagccaccaaaaacgtcactgtgttaaagcttctcgagaccaaacctcccaacataaccgtcctcaccgtggactccctcatcgtccccaccggaatcgatatcaccgcatcggagactctcactccaccgccgacgtcaacatctctctcccctccaccggcgggaatcaatctcactcagatactaatcaacggacacaacttcaacgtcgctctatccctcctcgtcgcttccggtgtcataacagaattcgaaaacgacgaacgtggcgccggcatcacagtcttcgtccccaccgactccgccttctccgatctcccttccaacgttaacctccagtcattaccggcggagcaaaaagcattcgtgttaaaattccacgtgctacattcatactacactctcggttcactagaatcaataaccaacccggttcaaccgacattagccactgaagaaatgggagccggttcatacactctcaacatctcccgggttaacgggtcaatcgtaacgatcaattcgggtgtggttttagctgttgtgactcaaacggcttttgatcaaaacccggtttctgttttcggagtatccaaagttcttttgcctaaagaactatttccaaaatcgggtcaacccgttgccacagctcctccacaggagatttctttgtcgccggagagttctagtgaacagccgtcacgactagtatcaccaccgcgtgagatagtttcttccggcgcggttaaaagaccacttggtttcttggtcttgtggtgttggtgtatagcattttgttatgttttggtatgatttttttttctttctttcttttatcacataatgttttgccttcgattagggctttatttatttttactggattttttttttcacaagggtttatatttattcacgataatgttattgtatttgagtcgaggaaaaaacaaattcactttcccatgt

SEQ ID NO: 870 - DNA, 2279 bp, Arabidopsis thaliana
tttactagacttttcacaattcaacacagttgttgttggttgagctacccagccagtatcaagagaggaaggtagagaggagtgagagagagctttgggatcgatttcatgtcgtagatctttcactctgggtttgcgttccacaaaatcctaattcgcggaactctggatttgatcggcgatggcggtaggcgatcagacggagcagaattacttgccgaagaagaagaaatccgaaacggaagatgataagaggaggaagaaaattgttcccgggagcttgttgaaagctgtggtgcgacctggaggaggtgattcgagccccgttgatggtgatcaggttaataattttggttttgtttttgcttctcgtggtcaattttggttgtttatgagtgttttttcgtcaggttatttatcactgcactgtacggacactggatggtgtagttgtggaatctacgaggtcagaatctggagggagaggtgtaccgatcagagatgtcttgggaaacagcaaaatgattcttggattgctcgaaggaattcccacgatgcacaagggtgaaattgcaatgttcaagatgaaacctgaaatgcactatgcagagattgattgtccagtctcagctccagaaaattttccaaaagatgatgagcttcattttgagattgagttgttggatttttctaaagccaagattgcaagtgatgatctgggggtcatcaagaagattctaaatgaaggtgagggctgggaatctcccagagaaccctatgaagtgaaagccagaatatctgctaaatccggtgatggacacgtgatcttctctcacacagaagaaccttatttcttcacatttggaaaatctgaggtgcctaaaggtcttgaaatcggaattggaaccatggctcggaaggagaaggcagtgatatatgttcgcaagcagtacttgactgaatctcctttgttgcatatagatcaagaccttgaggaagttcattttgaggttgaactggtacatttcattcaggtgcgggacatgcttggagatggacgtctcataaaacgtcgaattcgagatggaagaggcgagtttccaatggattgtcctctccaagatagtcgtttaagcgttcactacaagggcatgcttctcaatgaagagaagactgtcttctatgatagcaagattgacaataatgatcaaccgttggagttcagttcaggagaaggactggtccctgaagggtttgagatgtgtactcgtttgatgctacctggggagattgctcttgttacatgcccccctgattatgcatatgacaaatttccgagaccacctggcgtgtctgaaggtgcacatgttcagtgggagattgaactccttggtttcgaaacgccaagagactggactggcttgaacttccagagcatcatggacgaggcagataaaatcagaagcacgggtaataggcttttcaaagaaggaaaatttgagctcgcaaaagcaaagtacgaaaaggtgctccgggaatttaatcatgttaacccacaagatgaagatgaaggaaaaatatttggtgacacaaggaatatgttacatctgaatgttgcggcttgcttgcttaaaatgggagagtggaggaagtctatagagacatgcaataaggttctagaagcaaagcctggtcatgtgaaaggtctataccgccgcggaatggcttacattgcaggtggagagtatgatgacgctagaaatgacttcaatatgatgatcaaagtggataaatcatcagaagctgatgcgaccgctgctctattgaaactgaagcagaaggaacaggaagcggagagcaaggctagaaaacagttcaaaggattattcgacaagagaccgggggagataaccgaagttggttcagaaataagagaggagtctaaaactatagaagaagtagatgagacaaaggataatgatgatgatgaaacactggaagaagaaggagctacgacagtgagcacggaaaggaagaggaaatggtcggagaaagcctggccgtttctgaagaacgtgatgctccaaatcggaatccagcttggtgttgttctgatagggattttgattttccagtttgtgagcgccaaatttacatgagagagatatgaatgaataaacaaaccaacggcactgtagactcagaaaatataaaactaatggattaaacgttaagcttaatgtatttttgtttggtttagtttatgaaagtagttgctc

SEQ ID NO: 871 - DNA, 2509 bp, Arabidopsis thaliana
gagagaaagagttaagatgaatagagatagaaagagtcattaaatgtacgaagcgacattcacaataattcgaaaggtggaagacgacttagatacggccaggcttcactgtcctcctcgtcctcctcaattacccctaacccctttttccgggattcatctccaacccacatccttccaaattctcaccccctcactgagtttttgctttttctcctcatcggagatcgtgaagacgatcaagtaatttaagaatcccaccattgataaaagagtctagcttttctactaccaaacctttttctgtttggaaattttcgattttggatttaacccttttcttaccttatttataaccatgcaatctcacgaccaacaacccttcaatctccatggcggaatccggcgatttcaacggtggtcaacctcctcctcatagtcctctgagaacaacttcttccggtagtagcagcagcaacaaccgtggtcctcctcctcctcctcctcctcctttagtgatggtgagaaaaagattagcttccgagatgtcttctaaccctgactacaacaactcctctcgtcctcctcgccgtgtctctcaccttcttgactccaactacaatactgtcacaccacaacaaccaccgtctcttacggcggcggctactgtatcttctcaaccaaacccaccactctctgtttgtggcttctctggtcttcccgtttttccttcagaccgtggtggtcggaatgttatgatgtccgtacaaccaatggatcaagactcttcatcttcttctgcttcacctactgtatgggttgacgccattatcagagaccttatccattcctcaacttcagtctctattcctcaacttatccaaaacgttagagacattatcttcccttgtaacccaaatctcggtgctcttcttgaatacaggctccgatctctcatgctccttgatccttcctcttcctctgacccttctcctcaaactttcgaacctctctatcagatctccaacaatccttctcctccacaacagcaacagcagcaccaacaacaacaacaacagcataagcctcctcctcctccgattcagcagcaagaaagagaaaattcttctaccgatgcaccaccgcaaccagagacagtgacggccactgttcccgccgtccaaacaaatacggcggaggctttaagagagaggaaggaagagattaagaggcagaagcaagacgaagaaggattacaccttctcacattgctgctacagtgtgctgaagctgtctctgctgataatctcgaagaagcaaacaagcttcttcttgagatctctcagttatcaactccttacgggacctcagcgcagagagtagctgcttacttctcggaagctatgtcagcgagattactcaactcgtgtctcggaatttacgcggctttgccttcacggtggatgcctcaaacgcatagcttgaaaatggtctctgcgtttcaggtctttaatgggataagccctttagtgaaattctcacactttacagcgaatcaggcgattcaagaagcatttgagaaagaagacagtgtacacatcattgacttggacatcatgcagggacttcaatggcctggtttattccacattcttgcttctagacctggaggacctccacacgtgcgactcacgggacttggtacttccatggaagctcttcaggctacagggaaacgtctttcggatttcgcagataagcttggcctgccttttgagttctgccctttagctgagaaagttggaaacttggacactgagagactcaatgtgaggaaaagggaagctgtggctgttcactggcttcaacattctctttatgatgtcactggctctgatgcacacactctctggttactccaaagattagctcctaaagttgtgacagtagtggaacaagatttgagccacgctggttctttcttaggaagatttgtagaagcaatacattactactctgcactctttgactcactgggagcaagctacggcgaagagagtgaagagagacatgtcgtggaacagcagctattatcgaaagagatacggaatgtattagcggttggaggaccatcgagaagcggtgaagtgaagtttgagagctggagggagaaaatgcaacaatgtgggtttaaaggtatatctttagctggaaatgcagctacacaagcgactctactgttgggaatgtttccttcggatggttacactttggttgatgataatggtacacttaagcttggatggaaagatctttcgttactcactgcttcagcttggacgcctcgttcttagttttcttctcctttttcacaaacaatgtgcccataaatagatttacctgttttttttttgttatgtatcaaaaagagaggattttttgaagtcaaattgttctcactcacactctgtattggctacctgattggtggaatacatagaagttaatc

SEQ ID NO: 872 - DNA, 1840 bp, Arabidopsis thaliana
ttagccctgtttccagcaagagggcagagaagcagagagagagagagtgtgagagagaaagcagcttcttcttcttctcctcctcttctcccttatgtggatttcaaatccttctctgctactctctcttcacatttctctaccaacattcttcttctgacactcaacacacacactgcaacttccacagctaaatctagcaacaccaagtcaaaatccgccactaacgatgcttcttcaaaacttctccaacaccattttccttctctgcctcttcttcacactcctctccgccactaaacccctaaatctcactctccctcaccaacacccttcccctgattccgtcgctctccatgtcatcaggagtgtaaatgaatctcttgcaagaagacaactaagctcaccatcatcatcctcatcatcatcatcctcctcatcatcatcctcttgccgtaccggaaacccaatcgacgattgctggagatgcagcgacgcagactggtcaacaaaccgacaaagactagcagactgttcaatcggcttcggacacggcacactcggaggcaaaaacggcaagatctacgtcgtaactgactcatccgacaacaacccaacaaacccaacaccaggaacactccgttacggcgtaatccaagaagagccactctggatcgtcttctcttcaaacatgctcatcagactaaaacaagaactcatcatcaacagctacaaaaccttagatggtcgtggctcagccgttcacattaccggaaacggttgcttaactctccaatacgttcaacacatcatcatccacaacctccatatctatgactgtaaaccttcagctggattcgagaaacgtggtagatccgatggagatgggatctcgatcttcggatctcagaagatctgggttgatcattgttcaatgagtcattgcaccgacgggctaattgatgctgtgatgggttctacagctataactatatctaacaattacttcacccaccacgacgaggttatgttgttgggtcatgatgataactatgctcctgatacggggatgcaagtgacgatagcgtttaatcatttcggacaagggcttgttcagaggatgcctaggtgtcggagaggttacattcatgtagtgaataatgatttcactgagtggaaaatgtatgctattggtggtagtggtaatcccaccattaacagtcaaggaaatcgttactctgctccttctgatcctagcgccaaagaggtgacgaagcgagtggactcgaaggacgatggtgaatggtcgaattggaattggagaacagaaggggatttgatggagaatggagctttctttgtggcctctggtgaaggaatgagctcaatgtactctaaagcttctagtgttgaccctaaagctgcttctctcgtagaccagctcactcgaaacgctggcgtttttggcggtcccagggatgatcaaggtcagagtggcaattcttactctccttatggaggcgacggcggtggcggtgggagcagcggtgggagcagcggtggagggatggacgttatgggaggtacgacgagaggaagcagcagcagcagcggcgatgacagcaatgtcttccagatgatatttggaagcgatgcaccgtctcggccgcgtttaacgttattgttttctttgttaatgatttcggttttgtcgttatcaactctattattgtgacgaatggataacaaataggatttggaccgttcaattgattggtttttggtgtaaagtgtggctctctctccattattttctttaattgtagttggattggcaaca

SEQ ID NO: 873 - DNA, 774 bp, Arabidopsis thaliana
aactttttcaaaaaaaggaaaaaaaacagagctcactcattattatctctctaaaaaccctagctttctccatgggctttcccgtaggttacacagaggttttcttaccgaagcttttcgtacaaacgctttcgattctcggattcatcagaaccatcgtcttctctatcttccgcttcttgggtctctcagattttctcgaaatggatcaaacctggcccgattacacatcgtacccgacccgaatacccgaaacccgctcacctttctccgcactcctaattagagagatcctaccggttatcaaattcgaagagttaacgaattccggcgaagatctaccggaaaactgcgccgtttgtctatacgaattcgaaggagaacaagagatccggtggctgagaaattgcagacatatatttcaccggagctgtcttgaccgttggatggatcatgatcagaagacgtgtccactttgtagaacaccgtttgttccagatgagatgcaagaagagtttaatcaacggctatgggctgcttctggtgttcatgattttcactgtcccgtgaccgaattattatagaagaagccacgcttttctatctttttctgtgtcccttatgttcttttttgttttgactttcacccctctacttttgatgttgcttttttcacccctcttactgacatttagacttgccacgcttttatgtgtgtatatactccttacatatgaatgagagatgagcaataaatattaccgagacaggaaa

SEQ ID NO: 874 - DNA, 871 bp, Arabidopsis thaliana
aaaattagttcgtcgaagcatcgagaaaatgatcgtactttctgttggttccgcttcttcatctccgatcgtcgtcgtcttttccgtcgcgcttcttctgttctacttctctgaaacttctctaggagctccttgtcccatcaatggcttgccaatcgtgaggaatattagtgaccttcctcaggataactatggaagaccaggtctttcccacatgactgttgctggctccgtattgcatggaatgaaagaggttgaaatatggcttcagacatttgctccaggttcagagacaccaattcacaggcactcctgtgaagaggtttttgttgtcctaaagggcagtggtactctgtatctcgctgaaacacatggaaatttccctgggaaaccaatcgaatttccaatctttgccaacagtacaattcatattccgatcaatgatgctcatcaggtcaaaaacaccggtcatgaggacctgcaggtgttggttatcatatctcggccgcctattaaaatcttcatctacgaagactggtttatgccacacactgctgcaaggctgaagttcccttactattgggatgagcaatgcattcaagaatcacaaaaagacgagctttaaagcaaagtccgaggctaaaagcaagcacaacctttagatagtaaaatcatagttgaggttttgtgacactacgtagatactggtaaattggcaaggattttacatgaatgttgttgttaccagaaagtaaataaatgttcaatctttgatgttcttaagtaagtgagtcctattggtcatgaaaatatgtaagtgtgcacatcttgattgcatttgcgataaatttatagagtttcactcactttt

SEQ ID NO: 875 - DNA, 2249 bp, Arabidopsis thaliana
tagccgttctcttatgtctatatcactctctggctctcttctctttcttctatagcttctagtttctcccacttctcacttcctttttcccgaatcttgataatgtaaattcacaacaaatctgtttaaaaacaaccaatcaaaacccaacattgcttctcaacaaaaaagcaaagcaaaagattttgcgagagaaaaaaaagaaaatggatttgttcaagatccttcttcttgtgttcttcgtgaacataagtttctgcttcgctgcagatccatattctttctataacttcgaagtctcttacattactgcttctcctcttggtgtccctcaacaggtcattgctataaatggaaagtttcctggtcctacaatcaatgttacaaccaatgaaaatctggttgttaatgtcagaaacaagttagacgagggacttcttcttcattggaatggaatccaacagagacgtgtgtcatggcaagatggagttttaggaaccaattgtccaatcccaccaaagtggaattggacttatgagtttcaagttaaagaccaaattggtagtttcttctactttccatctctacatttccagagagcttctggtggttttggctcctttgttgtcaatcctagagctattattccagtccctttctctactccagacggtgatattaccgttaccattggtgattggtacataaggaaccacacggctttgaggaaggctttggatgatggtaaagatcttggaatgcctgatggagttctcattaatggaaaaggaccttaccgatacaatgacacgcttgttgctgatgggatcgatttcgaaacaatcacagtccatcctggaaaaacttatagacttcgagtgtcgaatgtgggaatctcgacgagtttgaactttaggattcaaggtcacaacttagttcttgcggaatcagaaggatcatacacagttcaacaaaactatacaagcttggatattcatgttggacagtcttattctttcttggttacaatggatcaaaacgcgagctctgattactacattgtcgcgagtgctcgggttgttaacgaaaccatatggagaagagtcactggagttggaatcttgaagtataccaactctaaaggaaaagctaaaggtcagttaccccctggaccacaagacgaattcgacaaaactttctccatgaatcaagcaagatccatcagatggaatgtatcagcaagtggtgcacgtcctaacccgcaaggatcatttaaatacggttcgatcaatgtaaccgatgtctacgttctaaggaacatgccgcctgtgacgattagtgggaagagaagaacaacgcttaatggcatatcgttcaagaatccttcaacacctattagactagctgataagcttaaagttaaagatgtgtataagcttgatttccctaagagacctttaactggaccagctaaagtggcgacttcgattatcaatggtacttatcgtggattcatggaagtcgttcttcagaacaatgacactaagatgcaaagctatcacatgagtggctacgccttctttgtcgtcggtatggattatggagagtggacagagaacagtagaggaacatacaacaaatgggatggtatcgcgcgttccactattcaggtgtatccaggggcatggtcagcgatattgatatcattagacaatcctggagcttggaatctaagaacagagaatcttgattcgtggtatcttggacaagaaacttacgttagagtggttaatccagacgaaaacaacaaaaccgaattcggacaccctgacaatgttctttactgtggtgctctcagcaaactacaaaagccacagaaggtttcatcgtcggcatcgaagagcattggattcacgagtctttctatggtggtaatggctttggtgatgatgatgatgcttcagcattgaaattgttaaatctgagggtttgttgtattttctagggttttgttgatatcaaaccagagatgatgattcttcttcttctttacgtttccacagttcttcttatttgggggttgttggatttctctgacttgtctttttttttttgtttctttttggattcaatctgttgttttattctttttcccgggatttgtttatttgagaagaagaaaaacaaatattcattaaaatgttttaaatttgttctaattaagctttggttattattgttttatctca

SEQ ID NO: 876 - DNA, 1793 bp, Arabidopsis thaliana
aaagaaagagaaagagaagagctggattcacatggtcttgttctttctctctccttcttttctcatcttgcggcttccctttctctctctatcgccacaatgatcattaccaaccaaactgattgaaactcatttgttctctctctctcaaatccactctctctctttcttttctcttctcctctctgtgtctctatcgccatggctgatgataaggagatgcctgctgctgtagttgatggacatgatcaagtcactggtcatattatttccaccacaatcggtggcaaaaatggtgaaccaaaacagacaattagttacatggcggagcgagttgttggtacaggctcgttcgggatcgttttccaagcaaaatgtttggagactggagaaaccgtggcgataaagaaggttttgcaagatagaagatacaagaaccgagaacttcagttgatgcgtgtgatggatcatccgaatgtggtttgtttgaagcattgcttcttttcgactacaagtaaagacgagcttttcttgaacttggttatggagtatgtccctgagagcttgtatcgagttctgaaacattatagtagtgcaaaccaaagaatgcctcttgtctatgttaaactttacatgtatcagatcttccggggacttgcttacattcacaatgttgctggagtttgtcacagagatctaaagcctcaaaatcttctggttgatcctcttactcatcaagtcaaaatctgtgactttggcagtgcgaaacagctcgttaaaggtgaagccaacatttcttacatctgctcacgattctaccgtgcacccgagctcatatttggtgccactgagtacacaacttctattgatatctggtctgctggttgtgttcttgctgagcttcttcttggtcagccattatttcccggagaaaatgctgtggatcagctcgttgaaattataaaagttcttggtacaccaactcgagaagaaatccgttgtatgaatccacattacacagatttcaggtttccacagataaaggcacatccctggcacaagatcttccacaaaaggatgcccccagaagcgattgattttgcatcaaggctgcttcaatactctccaagtctaagatgcacagcgctcgaagcttgtgcacatccgttctttgatgaactcagagaaccaaacgctcgtttaccaaatggacggcctttcccgcctctcttcaacttcaaacaagaagtagctggatcatcacctgaactggtcaacaagttgattccagaccatatcaagagacaattgggtctaagcttcttgaatcaatctggaacttaaaagggatcctgcaaaagacaactacttttttatatataatgtaccattacacgagccacaaggtcgtagttgaaggcaaacgtggaggacacaattcaaagtttttcctcctcaaactcgttcagacaaagccagctgctagcaaaaccaactcccccaaatctgcgaaaacaaaaactctccagtgttgtatctgcttatttctcttctcttttcaagtttggtgaaaaacacagtctcctctttgcttcatttcttctttctttcccccttatgtaaatgagtttagtcagaagtttttttatatagtaaagtttgggcagaaggtgaagaatgtaatcaaagtgatactctttcaacgaggagcttctttcaaacactttttttttttttcaaacacttcatgaatggatacatggttttgctttaagcataagtatatttgtatt

SEQ ID NO: 877 - DNA, 2847 bp, Arabidopsis thaliana
gaagaagaagaaggaccgcgagctttggatcgaatttgttaaatttttcttctctcgataataaaaacaacaaatgatcgttgatcgtttttctctagattcgattccgattccaaagaactagtctccggcgtgtaatctctgatcgttgaagatccaagctacgccgcatcttactcgccggcggcttgaatcatggctgataggagaaacaggtgtaaccagatcctccttttagcataccagagttttggcttagtgtttggagatttgagtatttctcctctctatgtgtataaatgtacattctacggaggattgagacatcaccaaacagaagatacgatatttggcgcgttttctttgatattttggaccatcactctcctttcactcatcaagtacatggtttttgtgttaagtgcagatgacaatggtgaaggagggatctttgctttgtatgctttgctctgcagacacgcaagattttctttgcttccaaatcagcaagctgctgatgaagaaatctctacatactatggtcctggagatgcaagtagaaatttgcctagttctgctttcaaaagccttatagaacgaaataaaagatcaaaaactgctttgcttgttttagtcttggtaggaacttccatggtaataaccatcggtgtccttacaccagcaatttcagtctcttcgtctattgatggccttgtggccaagacaagtctgaagcacagtactgtggtcatgatagcatgcgctttactggttggactttttgttctgcagcaccgtgggacaaataaagttgcctttctatttgcacctataatgattttgtggttgttgataattgcaactgctggtgtgtacaatattgtgacttggaaccccagtgtatacaaagccttatctccctactatatctatgtattctttagagatacgggaatagatggatggctatcccttggaggcattcttttatgcatcacaggaacggaggctatctttgctgaacttggccaatttacagccacatctataaggtttgcgttttgttgtgttgtttacccgtgtctggtgcttcaatacatgggccaagctgcgtttttatcaaagaatttttctgctctaccttcaagcttttattcttccattccagacccatttttctggccggttctcatgatggctatgctagctgcaatggtcgctagtcaagcagtcatatttgccacgttctcgattgtcaaacaatgctatgcattgggatgcttcccgcgtgtgaagattgttcacaaaccaagatgggtccttggccagatttacatccctgagatcaattgggttgtcatgatcctcacccttgctgtcaccatttgtttccgagacactcgacacatagcttttgcttttgggctcgcctgcatgactctagcctttgtgactacttggttgatgcctctcatcatcaactttgtctggaaccgtaatatcgtcttctccgtcctcttcatcctcttcttcgggaccatagaacttatcttcgttgcatcagccttagtcaaaatccctaaaggaggctggatcactctgctcctttccctcttcttcaccttcatcacatacgtatggcattacggcagcagaaagaagtacctatgcgaccagcacaacaaggtccctatgaaatcaatactaagccttggcccgagcctcgggatcatcaaagtccccgggatgggtcttatctacacagagctcgccagcggtgttcctgccacatttaagcactttctaacaaacttaccggcgttctaccaagttgtcgtctttgtctgctgcaaaactgtccctatcccgtatgtgccgcagaaagaacggtaccttatcggccggattggaccaaaaacatacaggatgtaccgatgcattatccgagctggctacaaagacgtgaacaaagacggagacgactttgaagacgagctggtgatgagcatcgccgagtttatccagctagaatccgaaggctatggtggctcaaacactgaccgttcgattgacggtcggctcgctgttgtgaaagcctcaaacaagtttgggacaaggctgtctcggtctatatccgaagccaacatcgcaggcagctcgagatcacagacaacagtaacaaacagcaagtctccggctctacttaaactgagagcagagtatgagcaagagcttccgaggctgagcatgagaaggatgtttcagttcagaccaatggacaccaagttcaggcaaccgcaggtgaaggaagagctgtttgatctggtgaatgctaaggacgctgaagtggcttacattgtcggacacggtcacgtgaaggcaaagcggaactcagtgtttgtaaaacagctggtggtaaacgtagcgtactcgttcttgaggaagaattgccggagcccaggcgtgatgttgaatattcctcacatttgtttgatcaaagtgggcatgaactattacttgtaagtgagagttttttctttttattactgatcctttgtgagagttttgtggttcgagtttcataaaattggatataatgtgtttttttgtttgtaatattttacttcttttatttcttggtaactttggtattggtgagacttcaaacgaagtctcaatgtctcagtctcagtgcctcggtttaatgtagaaaagtcataatgtaaaaagacagaaaacgatgtactggtgtggtgagtgggggatatcttcttgagcataaacttaaaaagaaaataataaaaatgtcagaagtgggatttgaacccacgccctcttacgaggacc

SEQ ID NO: 878 - DNA, 1702 bp, Arabidopsis thaliana
atatactatatgacctaattaattacacacacacacacaaaaacccattgaagaaaaaaaaagcgtggagagtgtgtgagaggacacgaaatggcaagaacccatttcattttccttcttcttgtagctcttttatcgacaacatttccatcatcatcatcttcaagagagcaagagaaggacagaatcaaagcacttccaggccaaccaaaagtggcattctcacaatactcaggctatgtcaatgttaaccagtctcatggtcgtgccctcttctattggcttactgagtcatcttctccttctccccacaccaagccccttcttctttggctcaatggaggaccgggctgctcgtcgattgcttatggagcttcagaggaaattggaccgtttcgtatcaacaaaaccggttccaatctctatctcaacaagttcgcttggaacaaagacgcaaaccttctgtttcttgaatcaccggccggagttggatattcctacacgaacacaagctccgatcttaaagactccggagatgaacgaacagctcaagacaacttgatatttcttatcaaatggttatcgagatttcctcaatacaaatacagagacttctatatcgctggtgaaagctatgccgggcattatgttcctcagcttgccaaaaagataaatgactacaacaaagctttctccaaaccaatcattaatctcaaaggattcttggtgggaaatgcagtgacggacaatcagtacgacagtataggaacagtaacttactggtggactcacgcaattatctccgacaaaagctacaagtcaatcctcaaatactgcaatttcacggtggagagagtttccgacgattgcgacaatgcggttaactacgctatgaaccatgagtttggtgacattgatcagtacagcatttacaccccaacgtgcgtggctgctcaacagaagaagaacacaaccggtttctttgtgcggatgaagaacacactcttgcgtagacggttagtgtctggctatgatccttgtacggagagttatgcagagaagtattttaaccgtcccgatgttcagagagccatgcacgctaatgttactggaattcgctataaatggacagcttgcagtgatgttctgatcaagacctggaaagattcggacaagaccatgttgcccatatacaaggaacttgcagcgtccggtttgaggatctggattttcagcggtgatacagactcggtggttccagtgaccgcgacacggttttccctcagccatcttaatctcccggtgaaaactcgttggtatccttggtacactgataaccaggtgggaggatggacagaggtttacaagggactgacctttgcaacggtacgaggggcaggccacgaggtgcctttatttgaaccaaagcgtgctctcattcttttcagatcattcttggccgggaaggaactcccaagatcttattagctactttaataacctaaacatagagtaagagaaaatgtcccgaaggacaatttggctaccagattaggaacctattccgagtaaactcggtattcttctacttttttttctgttaaaagctcgattcatttccacaatttggaaactacaaaactatttgggagagcatttgagtaattgttgataatcaaaagaagacaaaggttcaaatatc

SEQ ID NO: 879 - DNA, 3023 bp, Arabidopsis thaliana
aaagcttttctctctcatcccactacaaatcttatatacaagtttcgcaaatcttgactcttcacgttgtggatctatctagagagataagtaagagagaggaagagtaaggaagaaagtggttgaactgtagcagagtctgaggtttgaatcttgtagttcccattgaagcatgcttcaccgttttttccgaaggaagttactcatccactgagagagaaagagggatttggagatagagaaagaaatttctcagatgggtttgtgagaattcacagcaagagcaagaaactcctatatcttcctttgcttccagagaccagcgtgatcaaaaacaaatatttttacggaacaaaattaaatagagagatcggagaggatcaaagatgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaaccaggggaatttggctaccacagatactagctgtgagtcagtggtgacgagtggtcaacaccacttgacccctcaacatcagcctcgtgatgctagtcctgctggattattgtccattgcggatgaaactttaacagagttcatttccaaggcgactggaaccgctgtcgagtgggtccaaatgcctgggatgaagcctggtccggattccataggaatcgttgctatttctcatggatgcacgggaatcgctgctcgtgcttgcggccttgtgggtcttgatcccacaagggtcgcggagatcctaaaggataagccttgttggttgcgtgattgcagatctctggatatagttaacgtactatccactgcaaatggtggaacccttgaactaatctacatgcagctttatgcgccgacaacactggcaccagctcgtgacttctggatgctacgttacacatctgtaatggaagacgggagccttgtgatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgagccatggagtgtgccagaagttcttcgttctctctatgagtcctccactttactcgcccaaagaactacaatggccgctctgcgctatttgaggcaaatatctcaagagatttcacaacctaacgtaacaggttggggaagaagaccagcggctcttagagcacttagccaaaggcttagcaaaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaaaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagagtttatggaagtcattaagcttgagagcttggggcactaccaagaagacatgatgatgcctgctgatatcttccttctgcaaatgtgcagtggggtggatgagaacgcagttgaatcatgcgcagagcttatatttgcaccaatcgacgcatctttctctgatgatgcaccaatcattccttccggtttccgcatcattcctctagattccaaatcagaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatgaccttttttccatgtttttccttaattatcaaaacacagacctttttttccggagatatatttatatatactcttactcttagttaatttgtatttagttatatcatctctaattttgaaagaatttacttacttt

SEQ ID NO: 880 - DNA, 1861 bp, Arabidopsis thaliana
cagaatccattccttaaatcgatttcatccagatctaaactcgagcttttgttgatcgaaaaaatggaagaggatttgattaagcgccttgaagctgcggttacgaggcttgaggggatctcaagcaacggaggaggagtagtttctctttcccgcggaggagatttctcctccgccgccggaatcgatatcgcgtcgtccgatccatcgattctggcttatgaagatctgatttctcaatgtgttggtagggctctgaccgccgctgagaaaatcggtggacctgttctagatgtgactaagatagtcgccgaagcttttgcttcccaaaaggagctgcttgttcgcatcaagcaaactcagaagcctgacctcgctggattggctggatttctcaaaccgttgaatgatgttacaatgaaagctaatgcaatgactgaaggaaaaaggtcggattttttcaatcacttgaaggctgcatgcgatagtttatctgcattggcttggattgctttcactgggaaagattgtggtatgagcatgccaatagctcatgtggaagaaagttggcaaatggctgagttttacaacaataaggttctggtggagtatcgtaacaaagacgcagatcatgtggagtgggctaaagccttaaaagaactttatttacctggtttaagggaatatgtcaaaagtcattaccccttgggacctgtatggaatgcatcagggaaacctgctagtgctcctgcaaagggtccacctggtgctcctgctcctccaccagcacccctcttcagtgctgaatcttcaaagccatcatcatcgtcaaaccagaaacaagggatgtctgctgttttccagcaactcagctcgggtgctgtgacctcaggtcttagaaaagtgacggatgatatgaagacaaagaaccgtgctgatagatctggagctgttagtgcggttgagaaggaaactcgtaccagtaaaccggccttttcgaaaactggaccaccgaaaatggaacttcaaatgggtcgcaagtgggctgttgagaaccaaattgggaagaaggacttggttatcagcgagtgtgattccaaacagtctgtgtacatatatggttgcaaagattctgtcttgcaaatacaaggaaaagtgaataacatcaccattgacaaatgcacgaaagtgggtgttgttttcacggatgttgttgctgcatttgagattgtgaattgcaacaacgtagaagtgcaatgtcagggttcagctcccacagtttctgtggacaacacaactggctgtcagttatatctaaacaaagactcattagagacagctataacaacagccaaatcaagtgagatcaatgtaatggtgcccggtgctacccctgatggagattgggtggaacatgcgctgcctcaacagtacaatcatgtgtttactgaagggaagtttgagacaacaccggtctcgcattcaggtgcctaagcaaaggagaaactattatcactctggattgtgcttgaatatcaggcctttttatactcatatactttgtttcttcagattataatagaggaaagaatctgtttgtttgtttgttggttttttcttttgtctctatcccccaattttgggtttggaggttgtgggtttttgattttttttgtgtgatctgatcatcttgtgtcttgttcgtccttggggttttggatttggatttgggtttctcgtttcttttgtttttacttgtgggcttgtcccgagtccttgctgatgacgttgtgcacaaatcatacttatcatggatagaaaaagttgcaatcctgtttttggaatatgcagttatttattt

SEQ ID NO: 881 - DNA, 2135 bp, Arabidopsis thaliana
attgagaaaacccttttaaaattctctatcgatctcatcacaaattttgctatatccacaattcatgtgcttaggcatatagttattcccaagaaaccggtttaactgtttacgtatgcaacctccggcaagcgcaggacttttccggtcgccggaaaatctcccttggccttataattacatggattatttggtcgctggtttcttggttttgacggccggaatacttctccgtccatggctctggttacgtctacgaaactcgaaaacgaaagatggagatgaagaagaagataatgaggagaagaagaagggaatgattccaaacggaagcttaggctggccggtgatcggagaaaccctaaacttcatcgcttgtggttattcttctcggcctgttaccttcatggacaaacgaaagtctttatacgggaaagtgttcaaaacgaacataatagggacaccaatcataatatcaaccgatgcagaggtgaataaagtggtgctccaaaaccatgggaacacatttgtccctgcataccctaaatcaattacggaactacttggagaaaactctattctcagcatcaatggacctcatcaaaaaaggcttcacacgctcattggcgcgttcctcagatctcctcacctcaaagaccggatcactcgagacattgaggcctcggttgttctcactttggcgtcttgggctcaacttccattggttcatgttcaggatgagatcaaaaagatgacgtttgagatattagtaaaagtgttgatgagcacatctcctggtgaagatatgaacattctcaaacttgagttcgaagaattcatcaaaggtttgatttgtatcccaatcaaattccctggcactagactctacaaatccttaaaggcgaaagagaggttaataaagatggtaaaaaaggttgtggaggagagacaagtggcgatgacaacgacgtctccggcaaatgacgtggtggacgtacttctaagagacggtggtgattcagagaagcaatctcaaccgtcagatttcgtcagcggaaagatcgtagagatgatgatacccggagaggaaacaatgccaacggcgatgaccttggctgtcaaattcttaagtgacaaccccgtcgctctagccaaactcgtggaggagaatatggagatgaagaggcgtaaattggaattgggagaagaatacaagtggaccgattatatgtctctctcttttactcaaaatgtgataaacgaaacgcttagaatggctaacattattaacggggtgtggaggaaagctctcaaggatgtagaaattaaaggttacttaataccgaaaggatggtgtgtattggcatcattcatatcggttcacatggatgaagacatttatgataatccctatcaattcgatccgtggagatgggacagaattaatggatcggcaaacagcagtatttgcttcacaccctttggtggtgggcaaaggctatgtcctggtttagagctgtcgaagctcgaaatatccatctttcttcaccaccttgtaacccggtacagttggacggctgaggaagacgagatagtgtcatttccgactgtgaagatgaagcggaggctcccgatccgagtggctactgtagatgatagtgcttctccgatctcacttgaagatcattaatagatcatttcaaagaacaaaactgtttgtgcaaagaggaagcagagaagtaaacaaatgatcttattaacaaatagtagagaagagaagcaaacaagattggtgggtaagacagaaagagccatacgtacagctagtgatggctcaaagatgagagattctaattataattttttttgtttgtcatgtcaaattataagcgttggttaggttgtccctttctcttttatttatcgtaccaaacgcaagttgagatatgattccatatatatggatgatagatatgtatattaatatataccttcttctttttttggcagctattaacattatgcctatctcgtctctatctagcttttgttttatgctcgagaaaatttagacgaaaatatatcgaaaaatcgacgactagtctcgatcgataatatgatgatcacttcattta

SEQ ID NO: 882 - DNA, 4166 bp, Arabidopsis thaliana
gtcttttgactctcttctctctctcctctctttctgctttcctcaatctctctctttctatctctagagcttccacttcctctctaatggtggaaccaaaaccctagattccccctttcatcttctctacttcccacacttttctctctcacaaactcttgagaaatgaagactttttcaagcttctttctctctgtaacaactctcttcttcttctccttcttttctctttcatttcaagcttcaccatctcagtctttatacagagaaatccatcagcttataagcttcaaagacgttcttcctgacaagaatcttctcccagactggtcttccaacaaaaacccgtgtactttcgatggcgttacttgcagagacgacaaagttacttcgattgatctcagctccaagcctctcaacgtcggattcagtgccgtgtcctcgtctctcctgtctctcaccggattagagtctctgtttctctcaaactcacacatcaatggctccgtttctggcttcaagtgctctgcttctttaaccagcttggatctatctagaaactctctttcgggtcctgtaacgactctaacaagccttggttcttgctccggtctgaagtttcttaacgtctcttccaatacacttgattttcccgggaaagtttcaggtgggttgaagctaaacagcttggaagttctggatctttctgcgaattcaatctccggtgctaacgtcgttggttgggttctctccgatgggtgtggagagttgaaacatttagcgattagcggaaacaaaatcagtggagacgtcgatgtttctcgctgcgtgaatctcgagtttctcgatgtttcctccaacaatttctccactgggattcctttcctcggagattgctctgctctgcaacatcttgacatctccgggaacaaattatccggcgatttctcccgtgctatctctacttgcacagagctcaagttgttgaacatctctagtaaccaattcgtcggaccaatccctccgctaccgcttaaaagtctccaatacctctctctggccgagaacaaattcaccggcgagatccctgactttctctccggcgcgtgtgatacactcactggtctcgatctctctggaaatcatttctacggtgcggttcctccattcttcggttcatgttctcttctcgaatcactcgcgttgtcgagtaacaacttctctggcgagttaccgatggatacgttgttgaagatgagaggactcaaagtacttgatctgtctttcaacgagttttccggcgaattaccggaatctctgacgaatctatccgcttcgttgctaacgttagatctcagctccaacaatttctccggtccgattctcccaaatctctgccagaaccctaaaaacactctgcaggagctttaccttcagaacaatggcttcaccgggaagattccaccgactttaagcaactgttctgagctggtttcgcttcacttgagcttcaattacctctccgggacaatcccttcgagcttaggctctctatcgaagcttcgagatctgaaactatggctgaatatgttagaaggagagatccctcaggagctcatgtatgtcaagaccttagagactctgatcctcgacttcaacgatttaaccggtgaaatcccttccggtttaagtaactgtaccaatcttaactggatttctctgtcgaataaccggttaaccggtgagattccgaaatggattggccggttagagaatctcgctatcctcaagctaagcaacaattcattctccgggaacattccggctgagctcggcgactgcagaagcttaatctggcttgatctcaacaccaatctcttcaatggaacgattccggcggcgatgtttaaacaatccgggaaaatcgctgccaatttcatcgccggtaagaggtacgtttatatcaaaaacgatgggatgaagaaagagtgtcatggagctggtaatttacttgagtttcaaggaatcagatccgaacaattaaaccggctttcaacgaggaacccttgtaatatcactagcagagtctatggaggtcacacttcgccgacgtttgataacaatggttcgatgatgtttctggacatgtcttacaacatgttgtctggatacataccgaaggagattggttcgatgccttatctgtttattctcaatttgggtcataacgatatctctggttcgattcctgatgaggtaggtgatctaagaggtttaaacattcttgatctttcaagcaataagctcgatgggaggattcctcaggctatgtcagctcttactatgcttacggaaatcgatttgtcgaataataatttgtctggtccgattcctgagatgggtcagtttgagacttttccaccggctaagttcttgaacaatcctggtctctgtggttatcctcttccgcggtgtgatccttcaaatgcagacggttatgctcatcatcagagatctcatggaaggagaccagcgtcccttgctggtagtgtggcgatgggattgttgttctcttttgtgtgtatatttgggctgatccttgttggtagagagatgaggaagagacggagaaagaaagaggcggagttggagatgtatgcggaaggacatggaaactctggcgatagaactgctaacaacaccaattggaagctgactggtgtgaaagaagccttgagtatcaatcttgctgctttcgagaagccattgcggaagctcacgtttgcggatcttcttcaggctaccaatggtttccataatgatagtctgattggttctggtgggtttggagatgtttacaaagcgattttgaaagatggaagcgcggtggctatcaagaaactgattcatgttagcggtcaaggtgatagagagttcatggcggagatggaaaccattgggaagatcaaacatcgaaatcttgtgcctcttcttggttattgcaaagttggagacgagcggcttcttgtgtatgagtttatgaagtatggaagtttagaagatgttttgcacgaccccaagaaagctggggtgaaactaaactggtccacacggcggaagattgcgataggatcagctagagggcttgctttccttcaccacaactgcagtccgcatatcatccacagagacatgaaatccagtaatgtgttgcttgatgagaatttggaagctcgggtttcagattttggcatggcgaggctgatgagtgcgatggatacgcatttaagcgtcagtacattagctggtacaccgggttacgttcctccagagtattaccaaagtttcaggtgttcaacaaaaggagacgtttatagttacggtgtggtcttactcgagctactcacgggtaaacggccaacggattcaccggattttggagataacaaccttgttggatgggtgaaacagcacgcaaaactgcggattagcgatgtgtttgaccccgagcttatgaaggaagatccagcattagagatcgaacttttacaacatttaaaagttgcggttgcgtgtttggatgatcgggcttggagacgaccgacaatggtacaagtcatggccatgtttaaggagatacaagccgggtcagggatagattcacagtcaacgatcagatcaatagaggatggagggttcagtacaatagagatggttgatatgagtataaaagaagttcctgaaggaaaattatgagagttagaaacagagccaaagcagattctttgaacatcaaaatcatctaagggtcagtccgattttccttgggtctattttttttgtattttctactatatgctaagtgtatgtatctatgttatttatacataagacggatgttttttttttcgggctcggtcgaattgggggtggtggagaatagaactaagtaataactttgttaagaatatgtaaatatacagttttttggggagggatttgtaatgttttcgtttttagttctatggaaatttctacgttgctaacaaattaaatttataatgaatcatgaagaaacaaagagccaatgtgtattaaatttcgactgatcatgttcatgtaaatgcacgtgacctattaattcattattgtcggaattaatttgg

SEQ ID NO: 883 - DNA, 1518 bp, Arabidopsis thaliana
aaagagaaagtgtgaaaccaacttgttcatattgaaaagaaccattgctctctagattaaaagcttctctctctctctctctctctctctctctctctctctctctctctctcttttggactttctcaatccatatccctctctctgttttttctaatttgagcctctaaagtctcctcgttttgttcatgttgttgttcaagtgaagaagctcaattatgtttacaacattgttgtaatttcaaaacttcataagaatttctctgataataaagaaaaagctggagtagaactattttaaagtgtcatcatgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagctaaggtaaacggtgaagaagataacaacaacaacaaagctattacggagggtgttaaggaagaggaagttcacaagacggattcgattccttcgtctcctctgcagtttctagaacattcctctggttttaactaccggcgaagcttcactgacctccgtgaccttctaccgaattccaccgttgtcgaggctggatcttccgatagttgcgattcaagcgccgttcttaacgacgaaacaagttctgataacggaagattgacgccgcctgtgacggttactggcgggagtttcttacagtttgtgaaaacagagcaaacagaggatcacgaggattttctaagcggtgaagaagcttgtggtttcttctccgatgaacagccgccgtcacttcattggtactctgcttcagatcattggacttgagaattgtttatcaaattggtgctctgtttagtctcaatgggaaaacagagaagagggcaaaggtggaataattgataaataaggattaaggatgaaggggattattaaattaaatccgcgggagaagttaattttgggtttaagattgtaatggctcttcatgtaattaacgatgtcgagaggggctttcacagaaataggaatcaatggggacactctgatatgaaagcaataaaactacgtttgaccccttaagtctgaattgtattacatttcctacccctaaacttttcaattgagtaatataacctatatcttaatcc

SEQ ID NO: 884 - DNA, 633 bp, Arabidopsis thaliana
ggtagaaaatgagagatagaatggagagacttgtggtgcttcctttctccatcggatgtatctccgtctcaagtgttgccgttttgtctcctctctctaagcctcatcatcatcactctcgtcaagtgattcgtgaacaagaggaggaagataacatgaagaatgtattcaagttccttgcggtttctaaaccggagatttctatcggtattaaccggattttcaagagcttcaagaccatttctcaactctttgctgacaaagatgaagagaaggaagaagtcgaaacatcaggaatggagataggagttccaacgaacgtaaaacatgtatcgcacatcggttgggaaagcggtctaaccgcggctacaggtcctggtaaaggatgggaagatctcataccgccggagttgcttgcagccgctgcttcaaaaaaagaaattaaccctcatcttcatccaactttataatccactccctctatttttattttatttgatgttttgtttaagaatctagacatattgatatatatatggtgaatctgatctatgatataaactatgttatgcggtaaatataatcgttatgtaaatattttgtatgttaatcataagatatgatattagtacc

SEQ ID NO: 885 - DNA, 1788 bp, Arabidopsis thaliana
cgcagattgagctccagagagggagagagagagaaagggggcgctttagggtttctgcagttcctggttcagtctcaccattctatttaagggttttaatctctctgcttcatttggtgactaacatttatcgtcgagggttgtgacgatctccgagaatgtatagcggatctagcgatggtgagagtcatgatacatcgacgcagaggaagatcccaccggcgtcttcgatgctttgggttagaaatctacgacgatatattggttccggtgccggattaggatccgaagctctaatggagcttgagacgaagagaatcttgctcgagatttttaaagagaagcaacagaaaagccaagaagcaggcacaataccgagtttctacaagaagaaaccagaagaaggatctattagtcaaagggtccagaagcttgcaaagtaccgtttcttgaagaaacaatcggatcttttgttaaacgctgatgatttggctgctatgtgggtttgtttgagagaaaattgtgtgattgatgatgccactggtgctgaaaagatgaactatgaagacttctgtcacattgcctctgtatgcactgaacaaatcggtcccaaatgtcgccggttttttagcccatccaatttcatgaaatttgagaaggatgaggctgggaggattgccattttaccgttttatctttatgtgatgcgcacggtgtcgcttacacaagctaggattgatatgagtgagcttgacgaagactctgatggtttccttcattctgatgaaatggagtcctatattggtggtctaatccctaatctggcacaactgagagacatgcctccggcctttaatcaaatgtattgccgcatagcttcacaaaagtttttcttcttctgtgatccccataggcgaggaagagcctgcattaaaaagatactgctcagtaactgtctgcaggaactaatggaattgcatcaggaaagcgaggaggaagtcacagacactgaacaggcagaaaattggttctctttgacttcagcccaacgcatatgtgatatgttcctcgcacttgataaagatatgagtggatcgctgtgcaaacaagaacttaaagaatatgctgatgggaccctaactgagattttcattgaaagagtgttcgatgagcatgtccgccgtggtaaaatcgtggcaggcaattcccgggaaatggactttgacagtttcctcgattttgttcttgctttggagaacaaagatactccagagggtttgacgtatttattccgttgccttgatctccaagggagaggctttctcactactgctgatattcactctcttttcagagatgttcaccagaaatggatagaaggtgggaactatgaactgtgcatagaagatgttcgagacgagatctgggacatggtgaaaccgtctgacccattaaagatcactctgggtgatctcttgggatgtaaacaaggtggaaccgttgcgagcatgcttatagatgtgcgtggcttctgggctcatgacaaccgtgagaaccttcttcaagaagaagaagaaccacctgaggaagagtctcagtgataatgttattttctatgtctacctaaaaaaaatgctaaatcattgagatcaaaagtctcgcactagtaaacagtctcatctcatgtgtgtgtatctttgtaagcttattagttggtgacgtttaatgaaatggctgtttatatcgtcacttgtcttattctacttgggatctgatttgatttttgac

SEQ ID NO: 886 - DNA, 2134 bp, Arabidopsis thaliana
gtgaaaatacgataagagaaagaaaaaaaaaaaacagagaaggtaagaaaaattcaaagcgaggttctcgggaaccaatctggaaggaggaggggtgcagagagagagagagagagagagaagcgaagacgatggcgatgatagggatgaacattattgggctattcatggttcttatgttgcttctcatctccctcatcatccttttcgcctgcaagccatggcgatatttttctcgtttccgatcctcctctcgtttttcttctaccttcaaggtgggggatttgcagagaccacttatttctgatgatggaaatttgatccaaggacaaaccagtgaggtaacaagggaatatgatttagagggagcttgctaccaaaatgatggacttttgcattcatctctgactgagggacggttttacaaacaaaggcttccttcgtcatctccccatttctcccaaggtgaaagctttgttctagaagtaatttctgaaccttctgacaatgctttggtgggccaaacgcttaaacttccagctgaaaaaggttccttggcagaagtgcaaacatatgactggcagaataacagaaatgaaaacttgcaatataatctggaaaaggatcgacttattaatctttctccgaggctcgtggaagatcaaagaagttggctgttcctggaagtcatcgcgggtcctgccattgggcttcaacatgctgtgaactccacaagttcctccaagctgccagtgaaacttggaagggtttctccttctgatttggcattgaaggactcagaagtctctgggaaacatgcacagataacatggaactctactaaatttaaatgggagctggtagatatgggtagcctaaatggaactctcgtaaactctcattcaataagtcatcctgatttaggcagccggaagtggggtaaccctgtcgagcttgcaagtgatgatataataactttgggaacaacaacaaaggtctatgtccgtatctcctctcagaatgagtttcagatacccttcaaaattggtgtggcctcagatcccatggctatgcgtcgaggaggcaggaaacttccgatggaagatgtttgtcattacaagtggccgcttcctggggctaataagtttggactgttttgtgtttgtgatggacatgggggatcaggggctgctcaatccgcaatcaaaattattccggaggttctagcgaatattttatcagactcgctgaggaaggagaaagtgttatcaaaaagggatgcttcggacgtccttagggacatgtttgctaaaacagaagctcgcctcgaagaacaccaatatgagggttgtacagctactgttctcttggtttggaaagacaatgaagaaaacttcttcgcacaatgtgccaatcttggggattcagcatgtgttatccatcttggtggcagatatatacaaatgactgaagatcatcgagtggttagcttgagcgagagaaaacgattccaagaagcaggactagccttgagagatggagagactcggctttttggtataaaccttgcgaggatgcttggagacaagtttccaaagcaacaagacagccgtttcagtgcagagccatatataagtgagcctttgcgtatcgatcaatctagtaaagacgtatttgctgtattggctagtgacgggttatgggacgtggtaagtccgaagaaagctgtgcagcttgtacttcagatgagagataaagagagagggagagagagtagtgcggagaagatagcaaacggtctgctgaatgaagctagagcgatgcgtacaaaggacaacacctccattatttacttagatttcgatacttccctgtaatgttaggaaacatcttttaagatatttgggaagtgtctttcttttgtgtaccatctttttatgtattagtatttttgttagggtataagagagacaaaaaaacctcagatgcagagatttaggatggatcgtcttggtgagcgacattggtttcattatctttacttatataattaataatattatcagttaaagtttctgtttcgtattttattctttggtgagaatgaatttcatcagacaatacaacttatcag

SEQ ID NO: 887 - DNA, 2214 bp, Arabidopsis thaliana
gtcaatcatattcttcttcttcttcttcctctgattcccccagaaaaaacctagctccttccctcatttccccccaaatctcacgacttatttatgctcgggggagactaatcaaaggtcaaaatccattagggagggaatcgaatctcgatcgatctcaatttcttctgagaaaagaaaaaaatgtcatcggagattgaggtggtggaagaaatccaatcgaatcccaaggagaatggggaatcgagttctaaagggattgaagaagagagcttgaagaacgatgtctatactgctgccgcttatggtgatttggagaagcttcatagattggttgagtgtgagggttcctctgtttccgagcctgatgctcttggctactatgctcttcagtggtctgccttgaacaaccgcgtcgccgttgcccagtaccttatcgagcatggtggagatgtaaacgcgacggatcatactggacagactgcattgcattggagtgctgttcgtggtgcgatacaagttgcagaactgttattacaagagggtgcaagagtagatgcaacggatatgtatggctatcaggcaacacatgttgccgcacagtatggccagactgcttttctttgtcacgttgtctcaaagtggaatgctgatcctgacgtgcctgataatgatggaagaagccccttgcattgggctgcatataaaggttttgcagattccattcgcctacttttatttctagatgcatatagaggacgacaagacaaagaaggttgcactcctctgcattgggctgccatccgaggtaatttggaggcttgcactgtcttggtgcaggctggaaagaaagaggatttgatgattactgacaagactgggctaacccctgcgcaacttgctgctgaaaagaatcacagacaagtttcttttttccttggtaatgctcgaagcctgcttgaaaagcgttgtgacggaagcagtcccctcggaagattgtcaaagttgggactcgctccagttctttggatcatgatcctgctgcttctgctcgtatatacgaattcggttgttttggcatccaatctgccaaagttaacgactgggattggtgcgcttgcatggctgggattcattcttgcaactgcaggattatttttgttctaccgctgtagcaggaaggatccaggttacatcagaatgaatatccatgatccgcaaaccatgaaagatgatgaaccactcttaaaaatagagctaaacaatcctgctttgcttgctgggaattggacacagctctgtgcaacatgcaagattatcagacctcttcgagctaagcactgttccacctgtgatcgttgtgtagagcaatttgatcaccattgtccttgggtatcaaattgtgttggaaaaaaaaacaagtgggaattttttctttttcttctacttgaagttctagcgatgctgataactggtggcgtcactcttgcaagagtcttgagtgacccttcagctccatcttcttttggagcatggatgagccatgtcgctagtaatcatgtgggtgctttatcctttctgctagtggaattctgcctcttcttttctgtcgccgtcttaacagtcatacaagcgtcacaaatatcaaggaacataaccacaaatgaaatggccaacgccctgcggtacagctacctaagaggtccaggtggtcggtttaggaatccttatgatctcgggtgcagaagaaactgctcggacttcttagtaaaaggttataacgaagatattgagtgtcatgaagaagacgcaacacagagaccagagggtattagcatgatgcagatgcagcggaatccaaatcttcaaaatggcaatggccatgttgctatcgatgttaacccgacacataattcacagtcagcacatgttcattctgccaactgcagccatagccataatagtaagtcaaagagtgacaatgttcctttgggtttgggacttggtcttagccgcaacccaacccgacctgttgtatctccataatatggcccgtgtcccaaatgtgcatttgtgttgtaagaaacacgttttctctcctcgagtcattgattacatcattatccgtttcatgtgaagatagtaatactcccttgttttcaattttctatgcaaaaattaaatgtcatgtttcttatcaattatttttagagt

SEQ ID NO: 888 - DNA, 1448 bp, Arabidopsis thaliana
ctcccctctgaagaagaaaagcaaaatccacgagagaaacagatagaaagttgcaaaagtgcgttcgatttttgcttcttcttctgtttcggattcggatttggatttggaatctgctcctttagcagaaccagaggaaatggtgacgtacgtgagcgcgttgttctacggattcggagggatagtcgtcgccggagtggcgctgctcgtggctttccaggagaagcttgtgtacgtcccagtgcttccgggtttaagcaagtcttatccgatcactcccgctaggctcaatctcatctacgaagatatttggcttcaatcatccgatggtgtacgtctccacgcttggttcatcaagatgttccctgaatgtcgaggtccaaccattttatttttccaggagaacgctggaaacatcgctcatcgtctggagatggttcgcatcatgatacaaaaattgaagtgcaatgtattcatgctttcatatcgcggctatggggcaagtgaaggctatccttcacaacaaggtatcataaaagatgctcaggctgcattggatcacctttctggaaggactgacattgatacatctagaatagttgtatttggaaggtcccttgggggagctgttggagctgtgcttaccaaaaacaatccagataaggtatctgcattgattctggaaaatactttcacatccattcttgatatggctggcgttttgctgccgttcttgaagtggtttattggaggaagtggtacgaaaagcctgaagcttcttaattttgttgtacgttctccctggaaaacaattgatgctattgctgagatcaaacaaccagtgcttttcctctctggactgcaagatgagatggtccctccatttcacatgaaaatgctgtatgcgaaagcggctgcccgtaaccctcagtgcacatttgtggagtttccaagtgggatgcatatggatacatggctgtctggtggtgaagtttactggaaaacaaacttgcaatttctcgaaaagtatgcgcctgagaaaaggaaagaagatacaggaaggtaacgatcaacgatgctgtgtttagaggaagattcgactcacttatttcctattgcaacctgaaacgacggtattgtttgttataagcatgtgtatacgtatgttgcatttgggagtgacagatacaacttgttcagagagtgagatattggacaggaacttttgtaagcagaaccagctagtggagatggcaagtgtaagctaatcagatgcatttgcttcgtctcagttttccttcttttttttgggttattttttttccaattgttgttggtgtttctcatctgatcgtaactatttcctctggatgatcatggctttgtagatgattgagaaaagtgaaaaaagacatggttatatgattatatcttgaatgtgttgatta

SEQ ID NO: 889 - DNA, 4321 bp, Arabidopsis thaliana
tttagcagaccttttggtagttgtcctggtcgctgatcatccctttccgacaactctgttgctctttctctcacgtttgagtcttaatcttcgattgtccttggtcatccttaagttttgtttttctctttcgattcattttccagatttctttttatagaaacccgtctctttgatttgattccccccaagaaaggaaagcaaaacaaagaagagcagctgaatcaagtaactttgtgggtgtttttgaattatctgactcgagataaagagcttcgttaaaaacggaatcttttttaaggtcgtatgctttgtttgtctctccggagattccgcgtgtgaaaagtcgtggtttttgatctctttgagatacttaaaatttccgagaaattggcggctctgtcggagataaaaagctgagatcttggagttccccatttctgattaacgattctctctgctgttacttgagctaggaagctattaacaacttgagtgaaagtttagggcttttgatgaagctctcacgcaaagagcttagctttgtataagctcagattcagattatttattgggtttattcttcagagaaagtaaagttgagtgatcatgaaagctccttcatcaaatggagtttctcctaatcctgttgaaggagaaaggagaaatataaactcagagctatggcacgcttgtgctgggccattgatttcgttgcctccagcaggaagtcttgttgtttacttccctcaaggtcacagtgagcaagtcgcggcttcaatgcagaagcagactgatttcataccaagttacccgaatcttccttccaagctcatatgcatgctccacaatgttacactgaatgctgatcctgagacggatgaggtctatgcgcagatgactcttcagccagtaaacaaatatgacagagatgcattgcttgcttctgacatgggtcttaagctaaacagacaacctaatgaatttttctgcaaaaccctcacggcgagtgacacaagtactcacggtggattttctgtaccccgacgagctgctgagaaaatctttcctgctctggatttctcgatgcaaccaccttgtcaggagcttgttgctaaggatattcatgacaacacatggactttcagacatatttatcgaggtcaaccaaaaaggcacttgctaactacaggctggagtgtgtttgtcagcacgaaaaggctctttgctggagactctgttctttttataagagatggaaaggcgcaacttctgttggggataagacgtgcaaatagacaacagcctgcactttcttcatctgtaatatcaagtgatagcatgcacatcggagttcttgcagctgcagctcatgctaatgctaataacagtcctttcaccattttctacaacccgaggtgggctgctcctgctgagtttgtggttcctttagccaagtataccaaagcgatgtacgctcaagtttccctcggtatgcggtttagaatgatatttgagactgaagaatgtggagttcgtcggtatatgggtacagttaccggtatcagtgatcttgatccagtgagatggaaaaactctcagtggcggaatcttcagattggatgggatgagtcagctgctggtgataggcccagtcgagtttcagtttgggacattgaaccggttttaactcctttctacatatgtcctcctccatttttccgacctcgcttttctggacaacctggaatgccagatgatgagactgacatggagtctgcactgaagagagcaatgccatggcttgataatagcttagagatgaaagacccttcgagtactatctttcctggtctgagtttagttcagtggatgaatatgcagcagcagaacggccagctaccctctgctgctgcacagccaggtttcttcccatcaatgctttcgccaaccgcggcgctgcacaacaatcttggcggcactgatgatccctccaagttactgagctttcagacgccgcacggggggatttcctcctcaaatctccaatttaacaaacagaatcagcaagccccaatgtctcagttgcctcagccaccaactacgttgtcccaacaacagcagctgcagcaattgttgcactcctctttgaaccatcaacaacagcaatcgcagtctcaacaacagcaacaacaacaacagttgctgcagcagcaacaacaattgcagtctcaacaacacagcaacaacaatcaatcgcagtctcagcaacaacaacaattgctccagcagcaacaacaacaacaactgcagcaacaacatcaacaaccgttacagcaacagactcagcagcagcagctaagaacacagccattgcaatctcactcgcatccacagccacaacagttacaacaacataagttgcagcaacttcaggttccacagaatcagctttacaatggtcaacaagcagcgcagcagcatcagtcgcaacaagcatctacacatcatttgcaaccacaattagtttcgggatcaatggcaagcagtgtcatcacgcctccgtccagctcccttaatcaaagctttcaacagcaacaacaacagtctaagcaacttcaacaagcacatcaccatttaggtgctagcactagccagagtagtgtaattgaaaccagcaagtcttcatccaatctgatgtccgcaccgccgcaagagacacagttttcacgacaagtagaacagcagcagcctcctggtctcaacgggcagaatcagcaaacacttttgcagcagaaagctcaccaggcacaggcccaacagatattccagcagagtctcttggaacagccgcatatacagtttcagctgttacagagattacaacagcaacagcagcagcaatttctttcgccgcagtctcagttaccacaccatcaattgcaaagccagcagttgcaacagctgcctactctctctcaaggtcatcagtttccgtcatcttgcactaacaatggcttatcgacgttgcaaccacctcaaatgctggtgagccgacctcaggaaaaacaaaacccaccggttgggggaggggtcaaagcttattcaggcatcacagatggaggagatgcaccttcctcttcaacgtcgccttccaccaacaactgtcagatctcttcttcaggctttctcaacagaagccaaagcgggccagcgatcttgatacctgatgcagcgattgatatgtctggtaatcttgttcaggatctttacagcaaatccgatatgcggctaaaacaagaactcgtgggtcagcaaaagtccaaagctagtttaacagatcatcaactagaagcatctgcctctggaacttcttacggtttagatggaggcgaaaacaacagacaacaaaatttcttggctccaacttttggccttgacggtgattccaggaacagcttgctcggtggagctaatgttgataatggctttgtgcctgacacgctactctcgaggggatatgactcccagaaagatcttcagaacatgctttcaaactatggaggagtgacaaatgacattggtacagagatgtctacttcagctgtaagaactcaatcttttggtgtccccaatgtgcccgccatttcgaacgatctagctgtcaacgatgctggagttcttggtggtggattgtggccagctcagactcagcgaatgcgaacttatacaaaggtgcaaaaacgaggctcagtggggagatcaatagacgtcaaccgttacagaggttacgatgagctgaggcatgatctagcgcgcatgtttgggatcgaaggacagctcgaagatcctcaaacatctgactggaaacttgtttatgtcgatcatgaaaatgacatcctcctcgtcggcgatgatccatgggaagaattcgtaaactgtgttcagagcattaagatcctttcatcagctgaggttcagcagatgagcttagacgggaactttgccggtgtaccagttactaatcaagcttgtagtggcgccacttcgtttaaccggtgatggcagaagagttctctcacagacaaagattcttttttcttcgttttgtaatataacttctcgttgataacatgtctcaagtttccactgggcactgtagagcatttacctgtaaaatatcttccactaagtttacacggagattttatttgctgtgagtcactgtttctaccaagtttaactgatcaactgaaaccgcttgtaaccaaaaagagaaggaaaaacatgaaatcagcaataaaatcacattttcaaactc

SEQ ID NO: 890 - DNA, 1017 bp, Arabidopsis thaliana
ctctgtctctcactttccttcattatttactcattgcccaaaataattcatttatcatatcctcaaacttttttttttctatacctcgaaatccaaaaaaataaatacattggtttagtgtggcattgatgtttttggtataaagctcttcaccaatgatagcttcagagagtaccaagagctgggaagctagcgcagtcagacaagagaatgaagaagagaagaagaaaccggttaaagattccggtaagcatccggtttatcggggtgtccgaaagaggaactggggaaaatgggtgtccgagatacgtgaacctaggaaaaaatcccgaatatggctaggaacgtttccttccccggagatggcggcgcgtgcacacgacgtagccgctcttagcatcaaaggagcctccgctatactcaatttccctgacctagccggctctttcccacgccctagctcgcttagccctcgagacatccaggtcgcggctctcaaagccgcacacatggagacctcacagtctttttcttcttcttcttctttaacgttttcatcttcacagtcttcttcttcgctagagtctctcgtgtcttcctccgcgaccggctccgaggagctaggggagattgtagagctcccaagtttgggatcgagctatgatggtttgactcagctaggtaacgagtttatattctctgactccgcagacttatggccttatccaccgcaatggtcagaaggtgattaccaaatgattcctgcctcgttatcacaagattgggatcttcaaggactgtataattattaagtcataatcataaaaatatactagtaatgctgtgtttaataattactttttaatgacccctttattttgtatagggcggctttaggtttatttgtctttgaatcttcttttctcaatttgtgggtgtgagagagctcgatatatgaatacttgtacatacttctcataacatgtgttttttttttcttaataaatgtggaaactt

SEQ ID NO: 891 - DNA, 1666 bp, Arabidopsis thaliana
cacaaaataatataaagtaaaaatatttcataattcgtctctcaccggaaaaataaataaagttagagagagagattcataatcatcaaacccacaaatccttttttttttttttgttaaaacccacaaatccttactcgtacggatctctctctctttaatatcctaattcttctcttcatcgatctgagatttttacgttttcatcggcttgaaagtttgaagagttttgtagcctgaaaaatggcgtcagtgggtatagctcctaatcctggagcaagagactctactggtgttgataaattgcctgaagaaatgaatgacatgaaaattcgtgacgataaagaaatggaagcgacagtggtagatggaaatggaacagagactggacatatcattgtgactactattggtggtagaaatggccaaccaaaacagacaattagctacatggctgagcgtgttgttggtcacggatcttttggtgttgtgttccaagcgaaatgtcttgagacaggagaaactgttgcgataaagaaagttttacaagataggaggtacaagaaccgtgagcttcaaaccatgaggctacttgaccatcctaatgttgtgtctctgaaacattgtttcttctcaaccactgaaaaagatgagctttacctcaatcttgttcttgagtacgttccagaaactgttcatcgtgttatcaaacactacaacaaactgaatcagagaatgcctcttatatacgtcaaactttacacttatcagatttttagagccttatcttacattcaccgatgcattggtgtgtgtcatcgtgacataaaacctcaaaacttgttggtaaatccgcacactcatcaagtaaagctatgtgattttggaagtgcaaaagtattggtaaaaggagaaccaaacatttcctacatctgctcgaggtattacagagcacctgaacttatttttggagcaaccgagtatacgacagccattgatgtctggtctgcaggatgtgttctagctgaactattgcttggacagcccttgttccctggtgagagcggtgttgatcaacttgtagagattatcaaggtcttgggaacgcctactagagaagaaatcaagtgcatgaacccaaactacacggaattcaaattccctcagattaaagctcatccatggcacaagattttccacaaacgcatgcctccagaagctgttgatttggtctcaagacttcttcaatactctcctaatctacgaagtgccgctctcgacacattagtccacccattctttgatgagttaagagacccaaacgcacgtctacctaatggacgtttccttccaccgcttttcaacttcaagcctcacgagctgaaaggtgtaccattggagatggtagctaagttagtacctgagcatgcaaggaagcagtgtccttggctcggtttgtgatttcctcttaatgtagcatgaacacaacaaacacttcttataaattacctctctatgtatcaatatgtcacaaactgatatgcaccctttgtttgttgtatgagtagagaaaaaaagagttattactatggttggttggttcataatgtaaaagcccaccaagattttttatctagataaagagtttgctacttctgcttttgta

SEQ ID NO: 892 - DNA, 1058 bp, Arabidopsis thaliana
tagatcattcatagacgtacgcatcatcaaatcaattcatcgtcgtcttccacaattgtcatcaccgatcgattttccgactccgacgtacctcctcttccccgttaccttctcagagtttttagtagtcttcctttggaacaatgagtgacgtgtttgatggatatgagcgacaatactgtgagctctcggcgagtctttcaaagaagtgttcctctgctatttcgcttgatggagaacaaaagaagcagaagttgtctgaaataaaatccgggctggaaaatgcagaagtattgattaggaaaatggatctcgaggcaaggacccttccacctaatcttaagtccagcctccttgtcaaattaagagaattcaagtctgatctgaacaatttcaaaactgaagtgaagagaatcacatctggacagttgaacgctgctgctcgtgatgagttgctagaagctggtatggctgacacaaagacggcttcagctgatcagagagcaagattgatgatgtcaactgagcgtctgggccgaaccactgacagagtcaaggacagtcgtagaacaatgatggagactgaagaaatcggtgtttcaatcctccaagacttgcacggtcagagacagtctctcttacgtgcccacgaaacgcttcatggagtagacgataacattggaaagagcaagaagatcttgacagacatgacgaggaggatgaacaagaacaaatggaccattggagccatcatcatcgcattgattgccgccattttcatcatcttgtacttcaaactcaccaagtaagcctctgtaactaaatccgaccaaatcaaagaacaacggttgttttcgttttgtgagtctttgatttatcctgtttcttctttttgtgtgaaaagttgttttgccacctttgtattctaaatttgaccatacatactttaagcaagtaaagcttcggcctaagtgtcacgtatattgtttatattgttcatatcaaatccagaactatacatggttaaacattgagattaaaagcctcaattatttcaa

SEQ ID NO: 893 - DNA, 2360 bp, Arabidopsis thaliana
acatttcttcacttccacacacttttacttctttctctcttctcttctcttctccagatctgatcccaaacctttgattcattgttgttgttctctgctgctttatcagagagcatcatcatgtacggaagagatccatggggaggtccattggagataaacactgcagattccgccaccgacgatgatcgtagtcggaatttaaacgatttggatcgtgcggctctttcacgtccactagatgagacgcagcagagttggttacttggtccaacggagcagaagaagaagaagtacgtcgatctcggttgtattatcgttagccgcaagatcttcgtctggactgttggtactcttgttgccgccgcgttactcgccggattcattaccttgatcgttaaaactgtgccgcgtcatcatcctaagactccgccgccggataattatactatagctctacacaaagctcttaagttcttcaatgctcagaaatctgggaaattgccaaagcataataacgtgtcatggagaggtaattctgggcttcaagatgggaaaggtgaaacaggaagcttctataaagatttggtgggaggttattatgatgctggtgatgctatcaagttcaatttccccatggcttatgctatgactatgttgagctggagtgttattgaatatagtgctaaatacgaagctgctggtgagctcactcatgttaaggagcttatcaaatggggaactgattactttctcaagactttcaatagtactgctgattccattgatgatcttgtgtcacaggttggatcagggaatactgatgatggaaatacagatcctaatgaccattactgttggatgcgacctgaggatatggactataaaaggcccgtgactacttgtaatggtggatgttcggatctcgctgcagagatggcagctgctctggcttcagcatctattgtattcaaggataacaaggaatattctaaaaagcttgtccatggtgctaaggtggtgtatcagtttggaaggacgaggagagggagatatagtgcaggcactgcggaatctagcaagttctataattcaagtatgtattgggatgagttcatttggggtggtgcttggatgtattatgctaccggaaatgtaacgtatctcaatctaatcacccaacctactatggccaagcatgctggtgccttctggggtggcccttactatggtgtatttagctgggacaacaagcttgctggtgctcagttgctgttgagccggttgaggttgtttctgagtcctggatatccatatgaagaaattctaaggaccttccacaatcagaccagcatagtcatgtgctcatacttgcctattttcaacaaatttaacagaaccaatggaggtttaatagagttgaatcatggagctccacagccgctgcaatattctgtaaatgcagctttcttagcgactctatacagtgattatctggatgctgctgatactcctggatggtactgtggacctaatttctattcgacaagtgtgctacgtgactttgctagatcccagattgattatatactgggtaaaaaccctcggaaaatgagttatgtcgttggttttggcacaaaatacccaagacatgtgcatcacagaggagcttcgatacccaagaacaaagtcaagtataactgcaaaggaggatggaaatggagagacagcaagaaaccaaacccaaacacgattgaaggagccatggttgctggtcctgacaagcgcgacgggtaccgtgatgtccgtatgaactacaactacactgaaccgactcttgcaggcaatgctggtctagtcgcagctcttgtggcattatcgggtgaagaagaagccaccggtaagatagacaaaaacactattttctcagctgttcctcctttgttccctactccaccacctccaccagcaccatggaaaccttgagaaagctagacttgtgtgattctgtcgctgctgccaaaaaaaatgaatgaggtaagaaggatttgggtgtgagaccagaagattagaagctaaacacaagtcagccataaccaaactactaaggatttcatttggctttactagatacaaacacggggtgggttactttaccacaagcattgtctttcttttctttttttgggttgctgttttgttcttgtgagatatcatatatatctatgcgttttactctgtatatgtttgataccaaacttgtattctttgataaacaatttaatgaactgtattaaacttttaactatgttttattgtgcaagtgtgagatcaacctggaataacaactgtagtctact

SEQ ID NO: 894 - DNA, 908 bp, Arabidopsis thaliana
gacttttacaaagacaagccttttcaacacactactgatcttgagaatcctctcttcaaagccatggcgttagaactatggcaaactctcaaagaagcaatccatgcttacacaggtctttctcctgttgtcttcttcactgctctagctctcgccttcgccatttaccaagtcatctcaggctggtttgcctcgccgttcgatgatgttaaccgacatcagagagctagatccttggctcaagaggaggagccaccgattcctcagcctgttcaagtcggtgagatcacggaggaggagcttaaacagtacgatggctctgatcctcaaaagccccttcttatggctatcaaacatcagatctatgatgttacacaaagcaggatgttctacggaccaggaggaccatatgctttgtttgcagggaaagacgctagccgagctcttgcaaagatgtcatttgaggagaaagacttgacttgggatgtctctggtcttggtccctttgagctagatgctcttcaagattgggagtacaagttcatgagcaagtatgctaaggttggtactgtcaaagtggctggttcagaacctgaaaccgcatctgtctctgaacccacagagaatgttgagcaagatgctcatgtaaccacaacgcctgggaagaccgttgttgataagagtgatgatgctcctgctgagactgtgttgaagaaggaggagtagagcccatttccaagatttgctctgatttgtcatagagaccagttttatgaaaaggattgtagaatctctaatgttgaagtgtcaatgataatcttgttttactttcccaaaaaataaagattgctgattaatgataagaaaaaaatgttttataaactgcatatcagaaggcgttgcattgc

SEQ ID NO: 895 - DNA, 1156 bp, Arabidopsis thaliana
aaacaaaagctttagatctttcttcttaatggacattccgtattaccactacgaccatggcggagacagccaatatcttccaccgggtttcaggtttcatcccacggacgaagagctcatcactcattaccttctccgcaaagtcctcgacggttgcttctcaagccgtgccatcgcagaagttgatctcaacaagtgtgagccttggcaacttcccgggagagctaagatgggagagaaagaatggtacttctttagcctccgtgaccggaagtatccgacgggactgagaactaacagagcaactgaggctggttactggaaagctaccggaaaagacagagagatctttagttcaaagacttgtgcacttgttgggatgaagaagactcttgtcttttacaaaggaagagctccgaaaggagagaagagtaattgggttatgcatgaatatcgtcttgaaggcaaattctcttaccatttcatctcaagaagctccaaggatgaatgggtgatctctagggttttccagaaaaccactttagctagcaccggagccgtctccgaaggaggaggaggaggaggagcaactgtgagcgtaagcagcggtactggtccatctaaaaagacgaaagtaccctcaacaatctcaagaaactatcaagaacaaccaagctctccttcctccgtctcactcccacctctcctggatccgaccactaccctcggctacaccgacagcagttgctcctacgacagccgtagcaccaacacaaccgtcacagccagcgcaataaccgagcacgtgtcctgtttctccactgtccctactactactacggccttgggcttagacgttaactcattcagccgtcttccaccgccgctagggtttgactttgacccttttcctcgtttcgtttctagaaacgtctcgactcaatctaacttcagatcgttccaagaaaacttcaatcaatttccttactttggatcgtcttctgcatcgactatgacctccgccgttaatctgccttctttccaaggcggcggaggcgtctccgggatgaattactggctaccggcgactgccgaagagaatgagtcaaaggtcggtgtgcttcatgctggacttgactgtatttggaactactga

SEQ ID NO: 896 - DNA, 3557 bp, Arabidopsis thaliana
taaatatgaaaattcaaataattctccacaaatttttctattaataacaaatgtctacgacggaaccgtcgcctgagaatgatcgggatccacaaccgaccaccatatctactccgacttccaccaatgcgaagcttctgaagaagatccctgcgattcctttccgccattcggataaggaaggagaagatgaacaagcgaagacggacgaggttactacggaattagctggggaaggtccgatgagtcacgattcgccggaaattcttgctccttcttccttaggtttgaatcatatcagaacgaaatcgtctcctgcgccgtctcctttgagattttcatctgccacgcctttgatatctccgggtcaagatgataaagacgtcgccaaggagaaaccgagggttggtgttgttgatgctcgtgctgatgctcgtgccagatggccgattcctccacatcaacccgatcaagggaaaaaagttcagtggagtcaatcaaaatctcaacgagtgcctgcaaattcaaatccaggggtagagagtactcatgtaggtcttgccaaggaaacacaatctccacgttttcaggcgatattgcgtgtcacaagtggaaggaagaagaaagctcatgacattaagagcttctctcatgaacttaattctaaaggtgtgcgaccttttcccgtgtggagatctcgcgcagttggtcacatggaggagattatggcggcgatcagaacgaagtttgataagcaaaaggaagatgttgatgctgatttaggagtttttgctggctatttagtgacaactctagagagcacaccagaatctaacaaagaattaagagtgggtctagaggatttgttagttgaggctcggcaatgtgcaaccatgccagctagtgagttttggttgaaatgtgaaggtattgttcagaagcttgatgataaacgtcaggagctacccatgggaggactgaaacaggctcataatcgtcttcttttcattcttactcgttgcaataggcttgtgcaatttcgtaaagagagtggttatgttgaagaacacattctgggaatgcaccagctaagtgatcttggagtttatcctgaacagatggtggaaatctcgcgacaacaggaccttcttcgagagaaggaaatccaaaagataaatgaaaagcaaaatctagctggtaaacaagatgatcagaactcgaacagcggagctgatggagtggaagtaaatactgctagaagtactgattcaacttcgagcaattttcggatgtcatcttggaagaagcttccatctgctgccgagaaaaaccgtagtcttaataacactcccaaggctaagggggagagcaaaatccaaccaaaagtttatggtgatgaaaacgctgaaaacttgcatagcccgtcaggccagcctgcatctgcagacagaagtgctttgtggggtttctgggcggaccatcaatgtgtgacatacgataattctatgatttgtcgtatctgtgaagttgaaataccagttgtacatgtagaagagcactctcgaatatgcacaatcgctgatagatgtgacttgaagggaataaatgtaaacttaagacttgaaagagtagctgaaagtcttgagaaaattctggagtcatggacgccaaagagcagcgtaactccaagagcagttgctgatagcgcaagattatcaaattccagtagacaagaagatctggatgaaatctctcagagatgttcagatgacatgcttgattgcgttcctcgttcacagaatacattttctttggatgaactgaatatcttgaatgaaatgtctatgaccaatggaacaaaggactcgtcagcaggaagcttgacaccgccatcaccagcaacaccaaggaatagccaagtagatttgctactaagtggtcgaaaaacaatatcagagcttgagaattatcagcagataaacaagttgcttgatattgctcgttcggtggcaaatgtgaatgtatgtggatacagttcactggacttcatgattgagcagttggatgagctcaagtacgtcattcaggataggaaggctgatgcccttgtggtagaaacgtttggaagacgaatcgagaagctactgcaggagaagtacattgaactctgtggactgatagatgatgaaaaagtagactcatccaatgccatgccggatgaagaaagctcagcagatgaggatacagtacgaagcttacgggcaagcccacttaatccacgtgctaaagatcgaacatcaatagaagattttgaaattataaaaccaattagccgtggtgcatttggaagagtttttcttgcaaaaaagagagctaccggtgatttgttcgccataaaggttttaaagaaggctgatatgatccgtaagaatgctgttgaaagtattttagctgagcgtaacatccttatatcagttcgtaacccattcgtggttcgttttttctattctttcacatgccgggaaaatctctatctggtcatggagtacttgaatggtggagatctcttttccttgttgagaaatcttggttgcttggacgaagacatggcccgcatttatattgctgaagtggtgcttgctctggagtatctgcattctgtaaatatcattcacagagacttaaagccagacaatttgttgatcaatcaggatggtcacatcaagttgacagatttcgggctttccaaggttggtcttatcaatagcacagatgacttatcaggtgaatcatcattgggaaacagtggatttttcgcagaagatggatcaaaagctcaacattcacaaggcaaagatagtcgtaagaaacatgcagttgttggaacccctgattatctagcacctgaaatacttcttggaatgggtcatggtaaaaccgctgattggtggtcagtaggtgttattctctttgaggttctcgttggtattcctcctttcaatgcagaaaccccacagcaaatttttgaaaatataatcaacagagatataccatggccaaatgtgccagaggagatatcttatgaagcacatgatctgatcaacaagctgctaactgaaaatcctgtccaaagactaggggctacgggagctggagaggtgaaacaacatcattttttcaaagatattaactgggacacacttgctcggcaaaaggctatgtttgtaccatcagctgaaccacaagacactagttatttcatgagccgatatatatggaacccggaagacgaaaatgttcatggaggcagcgattttgatgaccttacagacacatgcagtagcagctcctttaatacacaggaagaagatggtgatgagtgtggtagcttagcagaatttggaaatggaccaaatcttgctgtgaagtattccttcagcaatttttcgttcaagaacctctcacaactggcttcgatcaactacgatcttgtcctaaagaacgcaaaggaatcagtagaagcttcgaaccagtcagcccctcgacccgaaacatga

SEQ ID NO: 897 - DNA, 1814 bp, Arabidopsis thaliana
cagaagacgcgcccagagtgacagtccttttagttattcttcttcccagtaatccacaaaccctagaaaattttctcaagaaaatccgaatcacgattctgggcattgtggaggattgacaaaaatgaagggaggtacgatacagataagttggcacgatgggaagccggtgctaaccgtagattttcacccgatttccggtttactcgccaccgccggagccgattacgatatcaagctatggttgataaattcgggtcaagcggagaagaaggttcctagtgtatcttatcagagtagccttacttaccatggatgtgctgtcaataccattcgtttttctccatctggggaactacttgcctcgggagcagacggaggtgagctttttatatggaagttgcatcctagtgaaaccaatcagtcctggaaagttcacaaatcattatcatttcatcgaaaggatgtcctggatcttcagtggtctcctgatgatgcatatcttatttctggctcagtggacaactcttgcattatatgggacgttaacaaaggttctgtccatcagatactggatgcccattgtcattatgttcaaggtgttgcctgggatcccttagcaaagtatgtagcctctcttagttcagacagaacatgccgtatatatgccaataagcctcaaacaaagagtaaaggtgttgaaaaaatgaactatgtttgccagcatgttatcatgaaagcagatcagcaacggggtgatgaaactaagacaataaaaacccatctctttcatgatgagacattgccgtctttctttcgaagattgtcatggtcacctgatggatcttttttactcattccagcaggttctttcaaggtttcacccacatccgaagctgtaaatgctacctatgtcttttctaggaaggacctttcaagacctgcactgcagcttcctggcgccagcaaaccggttgtagtggttcgtttttgccctgttgcatttaaactccgtggttcaagttctgaagagggtttcttcaagcttccttaccgtcttgtctttgccattgcaactttaaactccgtgtacatatatgacacagagtgtgtcgctccaattgcagtcttagcaggtctccactatgctgcaataaccgatataacatggtcacctaatgcatcgtatctggcactgtcctcacaagatggctattgcacactagttgaatttgaagataaagaactaggagaagctgtctccatttcagttggaaagaaacctgttgatggtgaggagaaaaagcatgatttagagaaaggcgatgaactaatgacagaaacaacaccagacgagagcaagaaacaagctgaattagaacaaaacgaagagagcaaacagccattgccaagcaaaattaccacggatggtaaggaaaaagagcatattatgcagaaaaccgatgatgaagtaatgacagaaacaagacatgaggaagagaatcagccattacagagcaaagttaacacaccggtctcaaataaaccagcaaggaaacgcatcacacccatggctattgacccctgatgtcgtcattttccatcagtgttttttttttaactctgatacaaatagctttctcataggctacatttagacatcaaaatgaatcgtattgacggccatgttggaaatggacttgtttctttagtcatacgtctcgtctctaaaggcaatgtacatatagacacatgtatgaacgttcacatgagatggttttgcgtacattgtggatcattattgggctcgtatt

SEQ ID NO: 898 - DNA, 1696 bp, Arabidopsis thaliana
atcgccgagtctgcttcttcttctctctctctctctctagtggtcacactcacttcacacccgtgaaaaaaccctaggaaccaaatatggtgaacctctcgagatccgtcgcgttgatctctgtattcctccttcctttacttagcttctctttctccgtcgataatccgacggatcggcgtgttcttgttcttctcgatgatttatcactcaaatcctctcattctatcttcttcaacactctcaagtctcgtggattcgatctcgatttcaagttagctgaagattcgaagcttgcgcttcaacgatacggccagtacttgtacgatgggttgatcatcttcgccccatcaacagaacggtttggaggatccttggattcgaaatccattgctgattttgttgattccggtcgtgacttgatcttatcggcggatactgctgcatctgatttgattaggggtattgccacagagtgtggggttgatttcgatgaggattcttcagctatggttattgatcatactagcttctccgtctctgatgttgacggcgaccacaccttgattgctgccgacgatttagtgaaatccgatgtcattttgggaaaaaccaagattgaggctcccgtgctcttcagaggagttgcacattcgttgaaccctactaacaatctggttttgaaagttctttcagcctctccatcagcttattctgctaacccaagctcgaagttgtctagtcccccccagctcactgggtcttcaatttcgctagtctcggtcatgcaggccaggaacaatgctagggttgtgatctcaggctcagtgcagttgtttagcgataggttaatcagatctggtgtccagaaagcagggagtccgaaccaatacgaaaaatctggcaacgaacagtttgtgactgaactaagcaaatgggtcttccacgaaaggggccatctgaaggctggtaatcttgtacaccatagggttggagaaacagatgagccagctatatataggataaaggatgacctggaattttctgtagagatatatgagtggtcaggaaagagctgggagccgtatgttgctaacgatgtgcaggttcagttttacatgatgagcccgtatgtgttgaaaaccctgtcaacagacaagaagggtctgtttcatacatctttcaaggttcctgatgtctacggtgtattccagtttaaggttgaatatgaaaagctaggctacactacattatctctttcgaagcagattccggtgcggccttacagacacaatgagtatgagagatttatcccaactgcgtatccttattatggagcctgctttacgacgatggctggtttcttcgtcttcagcttcgtctacctctaccataagtagaatcccttaaatggtggccaagtcccataaagtaagccaaacctccatatttagatgagaaaaaacaactttcgaactagagaccaatatttttgggcagcaaggttttcatatgtttctagttttagccaaacagttgcaaccttctttttgtttcccagatatttctatgttaacgtaactttacaccctttctctgctcctttctcctctctcccgtaatcaaagatataagtatgcccaaggcagctcaataatcaaccatttaaaacccataaatcaattcagggtaatat

SEQ ID NO: 899 - protein, 1014 aa, Arabidopsis thaliana
MASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPEKVSFAFFTRGGKYVECLLCVSKKLDREGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 900 - protein, 375 aa, Arabidopsis thaliana
MTSRYWVVSLPVKDSASSLWNRLQEQISKHSFDTPVYRFNIPNLRVGTLDSLLALGDDLLKSNSFVEGVSQKIRRQIEELERISGVESNALTVDGVPVDSYLTRFVWDEAKYPTMSPLKEVVDNIQSQVAKIEDDLKVRVAEYNNIRGQLNAINRKQSGSLAVRDLSNLVKPEDIVESEHLVTLLAVVPKYSQKDWLACYETLTDYVVPRSSKKLFEDNEYALYTVTLFTRVADNFRIAAREKGFQVRDFEQSVEAQETRKQELAKLVQDQESLRSSLLQWCYTSYGEVFSSWMHFCAVRTFAESIMRYGLPPAFLACVLSPAVKSEKKVRSILERLCDSTNSLYWKSEEDAGAMAGLAGDSETHPYVSFTINLA

SEQ ID NO: 901 - protein, 427 aa, Arabidopsis thaliana
MDPTSRPAIVIDNGTGYTKMGFAGNVEPCFILPTVVAVNESFLNQSKSSSKATWQTQHNAGVAADLDFYIGDEALAKSRSSSTHNLHYPIEHGQVEDWDAMERYWQQCIFNYLRCDPEDHYFLLTESPLTPPESREYTGEILFETFNVPGLYIAVNSVLALAAGYTTSKCEMTGVVVDVGDGATHVVPVAEGYVIGSCIKSIPIAGKDVTLFIQQLMRERGENIPPEDSFDVARKVKEMYCYTCSDIVKEFNKHDKEPAKYIKQWKGVKPKTGAPYTCDVGYERFLGPEVFFNPEIYSNDFTTTLPAVIDKCIQSAPIDTRRALYKNIVLSGGSTMFKDFGRRLQRDLKKIVDARVLANNARTGGEITSQPVEVNVVSHPVQRFAVWFGGSVLSSTPEFFASCRTKEEYEEYGASICRTNPVFKGMY

SEQ ID NO: 902 - protein, 1451 aa, Arabidopsis thaliana
MGRLKLHSGIKAIEEEPEDFECTDSSNTTTLACMIDTEIAAVLAVMRRNVRWGGRYMSGDDQLEHSLIQSLKALRKQVFSWNQPWHTISPMLYLQPFLDVIRSDETGAPITSIALSSVYKILNLNVIDQNTANIEDAMHLVVDSVTSCRFEVTDPASEEVVLMKILQVLLACMKNKASVMLSNQHVCTVVNTCFRVVHQAGMKGELLQRVARHTMHELVRCIFSHLPDVERTETTLVNRAGSIKQEKAGVDSDYAIVSKPVEDGNANSEYDVENSMATFATGAQSLMDDGPVGPGSRKPASPYDLHIMTEPYGVPSMVEIFHFLCSLLNVVEHVGMGSRSNTIAFDEDVPLFALNLINSAIELGGSSIRHHPRLLSLIQDELFRNLMQFGLSMSPLILSMVCSIVLNLYQHLRTELKLQLEAFFSCVILRLAQGKYGPSYQQQEVAMEALVNFCRQKSFMVEMYANLDCDITCSNVFEELSNLLSKSTFPVNCPLSAMHILALDGLIAVIQGMAERISNGLTGLDLGPVHLDEYTPFWMVKCDNYSDPNHWVSFVRRRKYIKRRLMIGADHFNRDPKKGLEFLQGTHLLPDKLDPQSVACFFRYTAGLDKNLVGDFLGNHDEFCVQVLNEFAGTFDFQYMNLDTALRLFLETFRLPGESQKIQRVLEAFSERYYMQSPEILANKDAALVLSYSIIMLNTDQHNVQVKKKMTEEDFIRNNRHINGGNDLPREFLSELFHSICNNEIRTTPEQGAGFPEMTPSRWIDLMHKSKKTAPYILADSRAYLDHDMFAIMSGPTIAAISVVFDHAEHEDVYQTCIDGFLAIAKISACHHLEDVLDDLVVSLCKFTTLLNPSSVDEPVLAFGDDAKARMATITIFTIANKYGDYIRTGWRNILDCILRLHKLGLLPARVASDAADESEHSSEQGQGKPLANSLSSAHLQSMGTPRRSSGLMGRFSQLLSLDTEEPRSQPTEQQLAAHQRTLQTIQKCHIDSIFTESKFLQAESLLQLARALIWAAGRPQKGTSSPEDEDTAVFCLELLIAITLNNRDRIVLLWQGVYEHIATIAQSTVMPCNLVDKAIFGLLRICQRLLPYKESLADELLRSLQLVLKLDARVADAYCEQIAIEVSRLVKANANHIRSQAGWRTITSLLSITARHPEASESGFDAVSFVMSEGTHLYPANYVLCVDAARQFAESRVGQSERSIRALDLMGDSLEFLAKWALSAKENMGEEDFGKMSQDIGEMWLRLVQGLRKVCLDQREDVRNHALQSLQKCLGGVDGINLAHSMWSQCFDKVIFTVLDDLLEIAAGSQKDYRNMEGTLLLAIKLLSKVFLQQLQELSQLSTFCKLWLGVLTRMEKYMKVKVRGKKSDKLQESVPELLKNILLVMKTKGVLLQRSALGGDSLWELTWLHVNNIAPSMRLELFPDQESSQLGDDETVSNGLSSPENTTGS

SEQ ID NO: 903 - protein, 476 aa, Arabidopsis thaliana
MLEIITVRKVFLIGFLILILNWVWRAVNWVWLRPKRLEKYLKKQGFSGNSYRILMGDMRESNQMDQVAHSLPLPLDADFLPRMMPFLHHTVLKHGKKCFTWYGPYPNVIVMDPETLREIMSKHELFPKPKIGSHNHVFLSGLLNHEGPKWSKHRSILNPAFRIDNLKSILPAFNSSCKEMLEEWERLASAKGTMELDSWTHCHDLTRNMLARASFGDSYKDGIKIFEIQQEQIDLGLLAIRAVYIPGSKFLPTKFNRRLRETERDMRAMFKAMIETKEEEIKRGRAGQNVTSSLFVWTLVALSQHQDWQNKARDEISQAFGNNEPDFEGLSHLKVVTMILHEVLRLYSPAYFTCRITKQEVKLERFSLPEGVVVTIPMLLVHHDSDLWGDDVKEFKPERFANGVAGATKGRLSFLPFSSGPRTCIGQNFSMLQAKLFLAMVLQRFSVELSPSYTHAPFPAATTFPQHGAHLIIRKL

SEQ ID NO: 904 - protein, 335 aa, Arabidopsis thaliana
MTSDGATSTSAAAAAAAMATRRKPSWRERENNRRRERRRRAVAAKIYTGLRAQGNYNLPKHCDNNEVLKALCSEAGWVVEEDGTTYRKGHKPLPGDMAGSSSRATPYSSHNQSPLSSTFDSPILSYQVSPSSSSFPSPSRVGDPHNISTIFPFLRNGGIPSSLPPLRISNSAPVTPPVSSPTSRNPKPLPTWESFTKQSMSMAAKQSMTSLNYPFYAVSAPASPTHHRQFHAPATIPECDESDSSTVDSGHWISFQKFAQQQPFSASMVPTSPTFNLVKPAPQQLSPNTAAIQEIGQSSEFKFENSQVKPWEGERIHDVAMEDLELTLGNGKAHS

SEQ ID NO: 905 - protein, 902 aa, Arabidopsis thaliana
MMASLSCVEDKMKTSCLVNGGGTITTTTSQSTLLEEMKLLKDQSGTRKPVINSELWHACAGPLVCLPQVGSLVYYFSQGHSEQVAVSTRRSATTQVPNYPNLPSQLMCQVHNVTLHADKDSDEIYAQMSLQPVHSERDVFPVPDFGMLRGSKHPTEFFCKTLTASDTSTHGGFSVPRRAAEKLFPPLDYSAQPPTQELVVRDLHENTWTFRHIYRGQPKRHLLTTGWSLFVGSKRLRAGDSVLFIRDEKSQLMVGVRRANRQQTALPSSVLSADSMHIGVLAAAAHATANRTPFLIFYNPRACPAEFVIPLAKYRKAICGSQLSVGMRFGMMFETEDSGKRRYMGTIVGISDLDPLRWPGSKWRNLQVEWDEPGCNDKPTRVSPWDIETPESLFIFPSLTSGLKRQLHPSYFAGETEWGSLIKRPLIRVPDSANGIMPYASFPSMASEQLMKMMMRPHNNQNVPSFMSEMQQNIVMGNGGLLGDMKMQQPLMMNQKSEMVQPQNKLTVNPSASNTSGQEQNLSQSMSAPAKPENSTLSGCSSGRVQHGLEQSMEQASQVTTSTVCNEEKVNQLLQKPGASSPVQADQCLDITHQIYQPQSDPINGFSFLETDELTSQVSSFQSLAGSYKQPFILSSQDSSAVVLPDSTNSPLFHDVWDTQLNGLKFDQFSPLMQQDLYASQNICMSNSTTSNILDPPLSNTVLDDFCAIKDTDFQNHPSGCLVGNNNTSFAQDVQSQITSASFADSQAFSRQDFPDNSGGTGTSSSNVDFDDCSLRQNSKGSSWQKIATPRVRTYTKVQKTGSVGRSIDVTSFKDYEELKSAIECMFGLEGLLTHPQSSGWKLVYVDYESDVLLVGDDPWEEFVGCVRCIRILSPTEVQQMSEEGMKLLNSAGINDLKTSVS

SEQ ID NO: 906 - protein, 2254 aa, Arabidopsis thaliana
MAGSVNGNHSAVGPGINYETVSQVDEFCKALRGKRPIHSILIANNGMAAVKFIRSVRTWAYETFGTEKAILLVGMATPEDMRINAEHIRIADQFVEVPGGTNNNNYANVQLIVEMAEVTRVDAVWPGWGHASENPELPDALDAKGIIFLGPPASSMAALGDKIGSSLIAQAADVPTLPWSGSHVKIPPNSNLVTIPEEIYRQACVYTTEEAIASCQVVGYPAMIKASWGGGGKGIRKVHNDDEVRALFKQVQGEVPGSPIFIMKVASQSRHLEVQLLCDKHGNVSALHSRDCSVQRRHQKIIEEGPITVAPPETVKKLEQAARRLAKSVNYVGAATVEYLYSMDTGEYYFLELNPRLQVEHPVTEWIAEINLPAAQVAVGMGIPLWQIPEIRRFYGIEHGGGYDSWRKTSVVAFPFDFDKAQSIRPKGHCVAVRVTSEDPDDGFKPTSGRVQELSFKSKPNVWAYFSVKSGGGIHEFSDSQFGHVFAFGESRALAIANMVLGLKEIQIRGEIRTNVDYTIDLLHASDYRDNKIHTGWLDSRIAMRVRAERPPWYLSVVGGALYKASATSAAVVSDYVGYLEKGQIPPKHISLVHSQVSLNIEGSKYTIDVVRGGSGTYRLRMNKSEVVAEIHTLRDGGLLMQLDGKSHVIYAEEEAAGTRLLIDGRTCLLQNDHDPSKLMAETPCKLMRYLISDNSNIDADTPYAEVEVMKMCMPLLSPASGVIHFKMSEGQAMQAGELIANLDLDDPSAVRKAEPFHGSFPRLGLPTAISGRVHQRCAATLNAARMILAGYEHKVDEVVQDLLNCLDSPELPFLQWQECFAVLATRLPKNLRNMLESKYREFESISRNSLTTDFPAKLLKGILEAHLSSCDEKERGALERLIEPLMSLAKSYEGGRESHARVIVHSLFEEYLSVEELFNDNMLADVIERMRQLYKKDLLKIVDIVLSHQGIKNKNKLVLRLMEQLVYPNPAAYRDKLIRFSTLNHTNYSELALKASQLLEQTKLSELRSNIARSLSELEMFTEDGENMDTPKRKSAINERIEDLVSASLAVEDALVGLFDHSDHTLQRRVVETYIRRLYQPYVVKDSVRMQWHRSGLLASWEFLEEHMERKNIGLDDPDTSEKGLVEKRSKRKWGAMVIIKSLQFLPSIISAALRETKHNDYETAGAPLSGNMMHIAIVGINNQMSLLQDSGDEDQAQERVNKLAKILKEEEVSSSLCSAGVGVISCIIQRDEGRTPMRHSFHWSLEKQYYVEEPLLRHLEPPLSIYLELDKLKGYSNIQYTPSRDRQWHLYTVTDKPVPIKRMFLRSLVRQATMNDGFILQQGQDKQLSQTLISMAFTSKCVLRSLMDAMEELELNAHNAAMKPDHAHMFLCILREQQIDDLVPFPRRVEVNAEDEETTVEMILEEAAREIHRSVGVRMHRLGVCEWEVRLWLVSSGLACGAWRVVVANVTGRTCTVHIYREVETPGRNSLIYHSITKKGPLHETPISDQYKPLGYLDRQRLAARRSNTTYCYDFPLAFGTALELLWASQHPGVKKPYKDTLINVKELVFSKPEGSSGTSLDLVERPPGLNDFGMVAWCLDMSTPEFPMGRKLLVIANDVTFKAGSFGPREDAFFLAVTELACAKKLPLIYLAANSGARLGVAEEVKACFKVGWSDEISPENGFQYIYLSPEDHERIGSSVIAHEVKLSSGETRWVIDTIVGKEDGIGVENLTGSGAIAGAYSKAYNETFTLTFVSGRTVGIGAYLARLGMRCIQRLDQPIILTGFSTLNKLLGREVYSSHMQLGGPKIMGTNGVVHLTVSDDLEGVSAILNWLSYIPAYVGGPLPVLAPLDPPERIVEYVPENSCDPRAAIAGVKDNTGKWLGGIFDKNSFIETLEGWARTVVTGRAKLGGIPVGVVAVETQTVMQIIPADPGQLDSHERVVPQAGQVWFPDSAAKTAQALMDFNREELPLFILANWRGFSGGQRDLFEGILQAGSTIVENLRTYRQPVFVYIPMMGELRGGAWVVVDSQINSDYVEMYADETARGNVLEPEGTIEIKFRTKELLECMGRLDQKLISLKAKLQDAKQSEAYANIELLQQQIKAREKQLLPVYIQIATKFAELHDTSMRMAAKGVIKSVVEWSGSRSFFYKKLNRRIAESSLVKNVREASGDNLAYKSSMRLIQDWFCNSDIAKGKEEAWTDDQVFFTWKDNVSNYELKLSELRAQKLLNQLAEIGNSSDLQALPQGLANLLNKVEPSKREELVAAIRKVLG

SEQ ID NO: 907 - protein, 909 aa, Arabidopsis thaliana
MGRIFEYFVVCGLGPEMRTVDGDLGFHGMQTFYLPALLDQFPPTDQSPYPAPPPQLPTCVLPAGVEFHSSGFVSSDPASFPRSYPIVLTEGDGSKIFVSCIAFRDRVCEDIIEAYRLPPNTYADKCICLVSHAPNFRVLRNSLEEIFVLCFSSEGSCKPLWDIIAYMVSNVPLPTPGKDRVLFAVENCLLSVEAPPEDSLPQADISLQPLVQCLDVDNLIKLFTSVLVERRILIRSNKYSLLTLVSESICHLIYPFRWLQVYIPLLFFSGVDYIDAPTPYMMGLHSDVDTSNLAMDGVVVVDLDINQITTSEEIPQIPEPEFSTLRNDILKLLHPNVVAIDQLKGFGNSVEQCPKSLSKPWGEDHDLQLRVIFLKCFASILGGYRNFIENKVFSTDAFLKRRSRSTNQPPEPMLVQFLGSFAFLDYLERRLSSDEKSTNLLEKLQDAVGRGQDAMSILPKSSMEPEIITIAEPEVEESATRYTYDRFPASVRSEEQEEKRKQILAAASGALESNGRHPPSSPPGKNTKEDNFSSMERAAERERMVLDIQVKLQGLWLRLLKLGSDEDPLSSFEYGTILALIESDAEGIGGSGFIECIREHLYSGWHGQLSEEQFIAVKELLKMAVGRAASRSDLSTVRDALEVSAEMFKKDANNVSDYVQRHLISIPIWEELRFWEGYFEYLMEQPANESVNYATLVTARLIIVASHMAGLGLPDTEAWNMIETIAEKQKLGYKLLIKLRGFLSHVQQLRVGYWGASSFKQQAISAGLPSPRPKDVSVSDETQQPSEASGRSWVQSMFSRDTASRANSFSRVRKWVSDNASSDITAAAQKKIQTNVRVLKGHGGAVTALHSVTRREVCDLVGDREDAGFFISGSTDCLVGIKCLIGKMFIWLFFIHQFFNHLVDVALHL

SEQ ID NO: 908 - protein, 324 aa, Arabidopsis thaliana
METEEEMKESSISMVEAKLPPGFRFHPKDDELVCDYLMRRSLHNNHRPPLVLIQVDLNKCEPWDIPKMACVGGKDWYFYSQRDRKYATGLRTNRATATGYWKATGKDRTILRKGKLVGMRKTLVFYQGRAPRGRKTDWVMHEFRLQGSHHPPNHSLSSPKEDWVLCRVFHKNTEGVICRDNMGSCFDETASASLPPLMDPYINFDQEPSSYLSDDHHYIINEHVPCFSNLSQNQTLNSNLTNSVSELKIPCKNPNPLFTGGSASATLTGLDSFCSSDQMVLRALLSQLTKIDGSLGPKESQSYGEGSSESLLTDIGIPSTVWNC

SEQ ID NO: 909 - protein, 382 aa, Arabidopsis thaliana; identical to SEQ ID NO: 193

SEQ ID NO: 910 - protein, 760 aa, Arabidopsis thaliana
MAAMFNHPWPNLTLIYFFFIVVLPFQSLSQFDSPQNIETFFPISSLSPVPPPLLPPSSNPSPPSNNSSSSDKKTITKAVLITAASTLLVAGVFFFCLQRCIIARRRRDRVGPVRVENTLPPYPPPPMTSAAVTTTTLAREGFTRFGGVKGLILDENGLDVLYWRKLQSQRERSGSFRKQIVTGEEEDEKEVIYYKNKKKTEPVTEIPLLRGRSSTSHSVIHNEDHQPPPQVKQSEPTPPPPPPSIAVKQSAPTPSPPPPIKKGSSPSPPPPPPVKKVGALSSSASKPPPAPVRGASGGETSKQVKLKPLHWDKVNPDSDHSMVWDKIDRGSFSFDGDLMEALFGYVAVGKKSPEQGDEKNPKSTQIFILDPRKSQNTAIVLKSLGMTREELVESLIEGNDFVPDTLERLARIAPTKEEQSAILEFDGDTAKLADAETFLFHLLKSVPTAFTRLNAFLFRANYYPEMAHHSKCLQTLDLACKELRSRGLFVKLLEAILKAGNRMNAGTARGNAQAFNLTALLKLSDVKSVDGKTSLLNFVVEEVVRSEGKRCVMNRRSHSLTRSGSSNYNGGNSSLQVMSKEEQEKEYLKLGLPVVGGLSSEFSNVKKAACVDYETVVATCSALAVRAKDAKTVIGECEDGEGGRFVKTMMTFLDSVEEEVKIAKGEERKVMELVKRTTDYYQAGAVTKGKNPLHLFVIVRDFLAMVDKVCLDIMRNMQRRKVGSPISPSSQRNAVKFPVLPPNFMSDRAWSDSGGSDSDM

SEQ ID NO: 911 - protein, 492 aa, Arabidopsis thaliana
MARKSLIFPVILLAVLLFSPPIYSAGHDYRDALRKSILFFEGQRSGKLPPDQRLKWRRDSALRDGSSAGVDLSGGYYDAGDNIKFGFPMAFTTTMLSWSIIDFGKTMGPELRNAVKAVKWGTDYLLKATAIPGVVFVQVGDAYSDHNCWERPEDMDTLRTVYKIDRAHPGSDVAGETAAALAAASIVFRKRDPAYSRLLLDRATRVFAFANRYRGAYSNSLYHAVCPFYCDFNGYQDELLWGAAWLHKASRKRAYREFIVKNEVILKAGDTINEFGWDNKHAGINVLISKEVLMGKAEYFESFKQNADGFICSILPGISHPQVQYSRGGLLVKTGGSNMQHVTSLSFLLLAYSNYLSHAKKVVPCGELTASPSLLRQIAKRQVDYILGDNPMGLSYMVGYGQKFPRRIHHRGSSVPSVSAHPSHIGCKEGSRYFLSPNPNPNLLVGAVVGGPNVTDAFPDSRPYFQQSEPTTYINAPLVGLLGYFSAHSTWR

SEQ ID NO: 912 - protein, 640 aa, Arabidopsis thaliana
MISWHDLYTVLTAVIPLYVAMILAYGSVRWWKIFSPDQCSGINRFVAIFAVPLLSFHFISTNNPYAMNLRFIAADTLQKIIMLSLLVLWANFTRSGSLEWSITIFSLSTLPNTLVMGIPLLIAMYGEYSGSLMVQIVVLQCIIWYTLLLFLFEFRGAKMLIMEQFPETAASIVSFKVESDVVSLDGHDFLETDAEIGDDGKLHVTVRKSNASRRSFCGPNMTPRPSNLTGAEIYSLSTTPRGSNFNHSDFYNMMGFPGGRLSNFGPADMYSVQSSRGPTPRPSNFEENCAMASSPRFGYYPGGGAGSYPAPNPEFSSTTTSTANKSVNKNPKDVNTNQQTTLPTGGKSNSHDAKELHMFVWSSNGSPVSDRAGLNVFGGAPDNDQGGRSDQGAKEIRMLVPDQSHNGETKAVAHPASGDFGGEQQFSFAGKEEEAERPKDAENGLNKLAPNSTAALQSKTGLGGAEASQRKNMPPASVMTRLILIMVWRKLIRNPNTYSSLIGLIWALVAFRWHVAMPKIIQQSISILSDAGLGMAMFSLGLFMALQPKLIACGNSVATFAMAVRFLTGPAVMAVAAIAIGLRGDLLRVAIVQAALPQGIVPFVFAKEYNVHPAILSTGVIFGMLIALPITLVYYILLGL

SEQ ID NO: 913 - protein, 988 aa, Arabidopsis thaliana
MDDLEQAIVISFETGAVDSALKSQAVTYCQQIKETPSICSICIEKLWFSKLVQVQFWCLQTLQDVLRVKYGSMSLDEQSYVRKSVFSMACLEVIDNENAGRVVEGPPFVKNKLAQVLATLIYYEYPLIWSSVFLDFMLHLCKGAVVIDMFCRVLNALDDELISLDYPRTPEEISVAARVKDAMRQQCVPQIARAWYDIVSMYKNSDPDLSATVLDCMRRFVSWIDIGLVANDAFVPLLFELILSDGLSEQVRGAAAGCVLAMVSKRMDPQSKLPLLQTLQISRVFGLVSGDVDSDLVSKVSALLTGYAVEVLECHKRLNSEDTKAVSMDLLNEVLPSVFYVMQKCEVDSTFSIVQFLLGYVSTLKGLPALKEKQLLHITQILEVIRIQICYDPMYRNNLNSLDKTGLEEEDRMSEFRKDLFVLLRTVGRVAPEVTQHFIRNSLANAVESSSESNVEEVEAALSLLYSFGESMTEEAMKTGSGCLSELIPMLLTTQFPGHSHRLVALVYLENITRYMKFIQENSQYIPNVLGAFLDDRGLHHQNFYVSRRAGYLFMRVVKLLKSKLVPFIDKILQNLQDTLSQLTTMNFASRELTGTEDGSHIFEAIGIIIGLEDVPAEKQSDYLSLLLTPLCQQIEAGLVQAKVASSEDFPVKIANIQFAIVAINALSKGFNERLVTASRPGIGLMFKQTLDVLLRVLIEFPKVEPLRSKVTSFIHRMVDTLGSAVFPYLPKALEQLLADSEPKEMVGFMVLLNQLICKFNSALHDILEEVYPVVAVRIFNVIPRDGLPSRPGAVTEEMRELIELQRMLYTFLHVIATHDLSSVFLTPKSRAYLDPMMQLVLNTSCNHKDITVRKACVQIFIKLIKDWCAEPYSEEKVPGFQNFVIEAFATNCCLYSVLDKSFNFSDANTHALFGEIITAQKVMYEKFGNTFLMHLMSKSFPSAHIPQDLAEQYCQKLQGNDIRSLKSYYQSLIENLRLQQNGSHVFR

SEQ ID NO: 914 - protein, 336 aa, Arabidopsis thaliana
MTSDGATSTSAAAAAAAAAAARRKPSWRERENNRRRERRRRAVAAKIYTGLRAQGDYNLPKHCDNNEVLKALCVEAGWVVEEDGTTYRKGCKPLPGEIAGTSSRVTPYSSQNQSPLSSAFQSPIPSYQVSPSSSSFPSPSRGEPNNNMSSTFFPFLRNGGIPSSLPSLRISNSCPVTPPVSSPTSKNPKPLPNWESIAKQSMAIAKQSMASFNYPFYAVSAPASPTHRHQFHTPATIPECDESDSSTVDSGHWISFQKFAQQQPFSASMVPTSPTFNLVKPAPQQMSPNTAAFQEIGQSSEFKFENSQVKPWEGERIHDVGMEDLELTLGNGKARG

SEQ ID NO: 915 - protein, 98 aa, Arabidopsis thaliana
MAISKALIASLLISLLVLQLVQADVENSQKKNGYAKKIDCGSACVARCRLSRRPRLCHRACGTCCYRCNCVPPGTYGNYDKCQCYASLTTHGGRRKCP

SEQ ID NO: 916 - protein, 447 aa, Arabidopsis thaliana
MREILHVQGGQCGNQIGSKFWEVICDEHGVDPTGRYNGDSADLQLERINVYYNEASGGRYVPRAVLMDLEPGTMDSIRSGPYGQIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISATMSGVTCSLRFPGQLNSDLRKLAVNLIPFPRLHFFMVGFAPLTSRGSQQYISLTVPELTQQMWDAKNMMCAADPRHGRYLTASAMFRGKMSTKEVDEQILNVQNKNSSYFVEWIPNNVKSSVCDIPPTGIKMASTFVGNSTSIQEMFRRVSEQFTAMFRRKAFLHWYTGEGMDEMEFTEAESNMNDLVSEYQQYQDATADEEDEYDEEEEQVYES

SEQ ID NO: 917 - protein, 334 aa, Arabidopsis thaliana
MMLAVEDVLSELAGEERNERGLPPGFRFHPTDEELITFYLASKIFHGGLSGIHISEVDLNRCEPWELPEMAKMGEREWYFYSLRDRKYPTGLRTNRATTAGYWKATGKDKEVFSGGGGQLVGMKKTLVFYKGRAPRGLKTKWVMHEYRLENDHSHRHTCKEEWVICRVFNKTGDRKNVGLIHNQISYLHNHSLSTTHHHHHEALPLLIEPSNKTLTNFPSLLYDDPHQNYNNNNFLHGSSGHNIDELKALINPVVSQLNGIIFPSGNNNNDEDDFDFNLGVKTEQSSNGNEIDVRDYLENPLFQEASYGLLGFSSSPGPLHMLLDSPCPLGFQL

SEQ ID NO: 918 - protein, 296 aa, Arabidopsis thaliana
MTVSSSPWALMALFLMVSSTMVMAIPPRKAIDVPFGRNYVPTWAFDHQKQFNGGSELQLILDKYTGTGFQSKGSYLFGHFSMHIKLPAGDTAGVVTAFYLSSTNNEHDEIDFEFLGNRTGQPAILQTNVFTGGKGNREQRIYLWFDPSKAYHTYSILWNMYQIVFFVDNIPIRTFKNAKDLGVRFPFNQPMKLYSSLWNADDWATRGGLEKTNWANAPFVASYKGFHIDGCQASVEAKYCATQGRMWWDQKEFRDLDAEQWRRLKWVRMKWTIYNYCTDRTRFPVMPAECKRDRDA

SEQ ID NO: 919 - protein, 1172 aa, Arabidopsis thaliana
MVSGVGGSGGGRGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 920 - protein, 619 aa, Arabidopsis thaliana
MFPRVSMRRRSAEVSPTEPMEKGNGKNQTNRICLLVALSLFFWALLLYFHFVVLGTSNIDKQLQLQPSYAQSQPSSVSLRVDKFPIEPHAAPSKPPPKEPLVTIDKPILPPAPVANSSSTFKPPRIVESGKKQEFSFIRALKTVDNKSDPCGGKYIYVHNLPSKFNEDMLRDCKKLSLWTNMCKFTTNAGLGPPLENVEGVFSDEGWYATNQFAVDVIFSNRMKQYKCLTNDSSLAAAIFVPFYAGFDIARYLWGYNISRRDAASLELVDWLMKRPEWDIMRGKDHFLVAGRITWDFRRLSEEETDWGNKLLFLPAAKNMSMLVVESSPWNANDFGIPYPTYFHPAKDSEVFEWQDRMRNLERKWLFSFAGAPRPDNPKSIRGQIIDQCRNSNVGKLLECDFGESKCHAPSSIMQMFQSSLFCLQPQGDSYTRRSAFDSMLAGCIPVFFHPGSAYTQYTWHLPKNYTTYSVFIPEDDVRKRNISIEERLLQIPAKQVKIMRENVINLIPRLIYADPRSELETQKDAFDVSVQAVIDKVTRLRKNMIEGRTEYDYFVEENSWKYALLEEGQREAGGHVWDPFFSKPKPGEDGSSDGNGGTTISADAAKNSWKSEQRDKTQ

SEQ ID NO: 921 - protein, 540 aa, Arabidopsis thaliana
MGGMKDEAKRITIPPLFPRVHVNDTGRGGLSQQFDGKTMSLVSSKRPNLPSPTNNISDSLSTFSLSLPPPPNNARLIDGPEKNQFSPIYNTKFEGKLNKKGINYTSPKGSSVTNTKPSSIKQNEYLKNLTSLDSIKSPIVIHSEIDPQANTDLSLQFCTSGSSKPGGEAVVGSKILLSERLEDENQNGSPNVMKTQSYRRNFAEFNNETQKKPKTLPRREQVASNCSAIESLSGISASSYDIARVIGEKRFWKMRTYMINQQKIFAGQVFELHRLIMVQKMVAKSPNLFLESKLNGVKHGTMRSSHQLAMAASKVRKPNTENHKPVPEEYPEHMKPKLPLPSISKELVTPIWPQQLLPPPGNQWLVPVITDSDGLVYKPFPGPCPPSSSAFMVPVYGQDSLETPFRFPVSSPFSHSYFPPPNARTTVDQTNPFGQFQRWSNTSSHMTQAIPFSLKKSQESNDSDIHGSTASSPPEKHKLEVLPLFPTEPTHQTDEYKQKQQPMLRAIKAVPHNSTSASESAARIFRFIQEERRDSDHMIS

SEQ ID NO: 922 - protein, 520 aa, Arabidopsis thaliana
MEEESSSWFIPKVLVLSVILSLVIVKGMSLLWWRPRKIEEHFSKQGIRGPPYHFFIGNVKELVGMMLKASSHPMPFSHNILPRVLSFYHHWRKIYGATFLVWFGPTFRLTVADPDLIREIFSKSEFYEKNEAHPLVKQLEGDGLLSLKGEKWAHHRKIISPTFHMENLKLLVPVVLKSVTDMVDKWSDKLSENGEVEVDVYEWFQILTEDVISRTAFGSSYEDGRAVFRLQAQQMLLCAEAFQKVFIPGYRFFPTRGNLKSWKLDKEIRKSLLKLIERRRQNAIDGEGEECKEPAAKDLLGLMIQAKNVTVQDIVEECKSFFFAGKQTTSNLLTWTTILLSMHPEWQAKARDEVLRVCGSRDVPTKDHVVKLKTLSMILNESLRLYPPIVATIRRAKSDVKLGGYKIPCGTELLIPIIAVHHDQAIWGNDVNEFNPARFADGVPRAAKHPVGFIPFGLGVRTCIGQNLAILQAKLTLAVMIQRFTFHLAPTYQHAPTVLMLLYPQHGAPITFRRLTNHED

SEQ ID NO: 923 - protein, 2236 aa, Arabidopsis thaliana
MKCVQVVIVRPLSSVSSLVRFAEEPQMFAIEFSDGCPVLVYASISRDNLLAAILDTLQTEGHCPIPVLPRLTMPGHRIDPPCGRVSLISGPQHLVADLETCSLHLKHLAAAAKDAVAEGGSVPGCRARLWRRIREFNACIPYTGVPANSEVPEVTLMALITMLPSTPNLPVDAPPLPPPSPKAAATVIGFVTCLRRLLSSRSAASHIMSFPAAVNRIMGLLRNGSEGVAAEAAGLIASLIGGWSADLSTAPDSRGEKHATIMHTKSVLFAQQGYVTILVNRLKPMSVSPLFSMAIVEVFEAMVCDPHGETTQYTVFVELLRQIAALRRRLFALFAHPAESVRETIAVIMRTIAEEDAIAAESMRDAALRDGALLRHLLNAFSLPASERREVSRQLVALWADSYQPALDLLSRVLPPGLVAYLHTRPDDVVDDTDQEGSSTNRRQKRLLQQRRGRIAKGMGAQDIPLPPGNNVEAGDAAKHMSANASVPDNFQRRAADSSSEASNPQASAFPGVDSTIAGVSQNGYPAFASVTTNANGHEQPETNASDVVGSDPNLYGIQNSVLPAPAQVIVESTAVGSGKLLLNWREFWRAFGLDHNRADLIWNERTRQELIEALKAEVHNLDVEKERTEDISPGDVEATTGQEIIPRISWNYSEFSVSYRSLSKEVCVGQYYLRLLLESGNAGKAQDFPLRDPVAFFRALYHRFQCDADMGLTIDGAVPDELGSSGDWCDMSRLDGFGGGGGASVRELCARAMAIVYEQHYNTIGPFEGTAHITALIDRTNDRALRHRLLLLLKALVKVLLNVEGCVVVGGCVLAVDLLTVVHENSERTPIPLQSNLIAATAFMEPPKEWMYIDKGGAEVGPVEKDVIRSLWSKKDIDWTTKCRALGMSDWKKLRDIRELRWAVAVRVPVLTPSQVGDAALSILHSMVSAHSDLDDAGEIVTPTPRVKRILSSTRCLPHIAQALLSGEPVIVEAGAALLKDVVTRNSKAMIRLYSTGAFYFALAYPGSNLYSIAQLFSVTHVHQAFHGGEEATVSSSLPLAKRSVLGGLLPESLLYVLERSGPAAFAAGMVSDSDTPEIIWTHKMRAENLICQVLQHLGDYPQKLSQHCHSLYDYAPMPPVTYPELRDEMWCHRYYLRNLCDEIQFPNWPIVEHVEFLQSLLVMWREELTRKPMDLSEGEACKILEISLNNVSSDDLNRTASVELNEEISNISKQIQNLDEEKLKRQYRKLAMRYHPDKNPEGREKFLAVQKAYECLQATMQGLQGPQPWRLLLLLKAQCILYRRYGHVLRPFKYAGYPMLLDAVTVDKDDNNFLSNDRSPLLVAASELVSLTCAASSLNGEELVRDGGVQLLSTLLSRCMCVVQPTTSQHEPAAIIVTNVMRTLSVISQFESARAGFLELPSLIEDIVHCTELERVPAAVDAALQSIAKVSVFPELQHGLLKAGALWYILPLLLQYDSTAEESNSVESHGVGVSIQIAKNEHALQASQALSRLTGLCADESLTPYNATAADVLKALLTPKLASLLKDEVAKDLLSKLNTNLETPEIIWNSATRSELLNFVDEQRACQCPDGSYDLKNAQSFSYDALSKEVFVGNVYLKVYNDQPDSEISEPESFCNALIDFISSLVHTELPSVSEDQNLIEDRNSSNDTPELQSSVAEPSLIEEHSDHQPSSEGMKNEECFLIDHLQLGLTALQNLLTKYPDLASVFSSKERLLPLFECFSVAIASKTDIPKLCLNVLSRLTAYAPCLETMVSDGSSLLLLLQMLHSAPSFREGALHVLYALASTPELAWAAAKHGGVVYILELLLPLQKEIPLQQRAAAASLLGKLVAQPMHGPRVAITLVRFLPDGLVSIIRDGPGEAVVHALERTTETPELVWTPAMAASLSAQIATMASDIYREQQKGSVIEWDVPEQSAGQQEMRDEPQVGGIYVRRFLKDPKFPLRNPKRFLEGLLDQYLSAMAATHYEQHPVDPELPLLLSAALVSLLRVHPALADHIGHLGYVPKLVAAVAYEGRRETMSSGEVKAEEIGSDGVNESTDPSSLPGQTPQERVRLSCLRVLHQLAASTTCAEAMAATSAGNAQVVPLLMKAIGWLGGSILALETLKRVVVAGNRARDALVAQGLKVGLIEVLLGLLDWRTGGRYGLSSHMKWNESEASIGRVLAVEVLHGFATEGAHCSKVREILDASEVWSAYKDQKHDLFLPSNTQSAAGVAGFIENSSNSLTYALTAPPPPSHP

SEQ ID NO: 924 - protein, 852 aa, Arabidopsis thaliana
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 925 - protein, 485 aa, Arabidopsis thaliana
MSEGVEAIVANDNGTDQVNGNRTGKDNEEHDGSTGSNLSNFLWHGGSVWDAWFSCASNQVAQVLLTLPYSFSQLGMLSGIVLQIFYGLLGSWTAYLISVLYVEYRARKEKEGKSFKNHVIQWFEVLDGLLGSYWKALGLAFNCTFLLFGSVIQLIACASNIYYINDHLDKRTWTYIFGACCATTVFIPSFHNYRIWSFLGLGMTTYTAWYLAIASIIHGQAEGVKHSGPTKLVLYFTGATNILYTFGGHAVTVEIMHAMWKPQKFKYIYLMATLYVFTLTIPSAAAVYWAFGDALLDHSNAFSLMPKNAWRDAAVILMLIHQFITFGFACTPLYFVWEKVIGMHDTKSICLRALARLPVVIPIWFLAIIFPFFGPINSAVGALLVSFTVYIIPSLAHMLTYRSASARQNAAEKPPFFMPSWTAMYVLNAFVVVWVLIVGFGFGGWASVTNFVRQVDTFGLFAKCYQCKPAAAAAHAPVSALHHRL

SEQ ID NO: 926 - protein, 856 aa, Arabidopsis thaliana
MGNGTSRVVGCFVPSNDKNGVDLEFLEPLDEGLGHSFCYVRPSIFESPDITPSNSERFTIDSSTIDSETLTGSFRNDIVDDPSFLNRHNSKGLAETTFKAISGASVSANVSTARTGNQMALCSSDVLEPAASFESTSSFASIPLQPLPRGGSGPLNGFMSGPLERGFASGPLDRNNGFMSGPIEKGVMSGPLDVSDRSNFSAPLSFRRKKPRFQRFMRSVSGPMKSTLARTFSRRSGGLSWMHRFFLHPETRVSWAVGKDGKLHGEDPESCLESNRNLQWAHGKAGEDRVHVVLSEEQGWLFIGIYDGFSGPDAPDFVMSHLYKAIDKELEGLLWDYEEPSEDNQLQPDQEPPTEENMCDPESISEQHSKSVVAESEEVMIDDISSLGNTDTQIADGPPGDSAGPGKKSMRLYELLQLEQWEGEEIGLKRYGGNVALNNMTNQVENPSTSGGGAGNDPCTTDRSALDGIPNSGQRHGTKKSQISSKIRRMYQKQKSLRKKLFPWSYDWHREEGICVEEKIVESSGPIRRRWSGTVDHDAVLRAMARALESTEEAYMDMVEKSLDINPELALMGSCVLVMLMKDQDVYVMNVGDSRAILAQERLHDRHSNPGFGNDEGIGHKSRSRESLVRIELDRISEESPIHNQATPISVSNKNRDVTSYRLKMRAVQLSSDHSTSVEEEIWRIRSEHPEDDQSILKDRVKGQLKVTRAFGAGFLKKPNFNEALLEMFQVEYIGTDPYITCEPCTVHHRLTSSDRFMVLSSDGLYEYFSNEEVVAHVTWFIENVPEGDPAQYLIAELLSRAATKNGMEFHDLLDIPQGDRRKYHDDVSVMVVSLEGRIWRSSGQYYPERKQKFNR

SEQ ID NO: 927 - protein, 409 aa, Arabidopsis thaliana
MASVGIEPSAAVRESTGNVTDADRLPEEMKDMKIQDDKEMEATIVNGNVTETGHIIVTTIGGRNGQPKQTISYMAERVVGHGSFGVVFQAKCLETGETVAIKKVLQDRRYKNRELQTMRLLDHPNVVSLKHCFFSTTEKDELYLNLVLEYVPETVHRVIKHYNKLNQRMPLVYVKLYTYQIFRSLSYIHRCIGVCHRDIKPQNLLVNPHTHQVKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPPEAVDLVSRLLQYSPNLRCAALDSLVHPFFDELRDPNARLPNGRFLPPLFNFKPHELKGVPVEMVAKLVPEHARKQCPWLSL

SEQ ID NO: 928 - protein, 802 aa, Arabidopsis thaliana
MDAACSTQLIDGDGVFNVSGVDHFIKEVKLDECGLSYAVVSIMGPQSSGKSTLLNHLFGTNFREMDAFRGRSQTTKGIWIARCAGIEPCTVVMDLEGTDGRERGEDDTAFEKQSALFALAVSDIVLINMWCHDIGREQAANKPLLKTVFQVMMRLFSPRKTTLMFVIRDKTRTPLENLEPVLREDIQKIWDSVPKPQAHKETPLSDFFNVEVVALSSYEEKEEQFKEQVYNLRQRFFQSVAPGGLAGDRRGVVPANAFAFSAKQMWQVIKDNKDLDLPAHKVMVATVRCEEIANEKFSSFIANENWRELEEAVQSGPVSGFGRKLSSILQASLSEYDTEATYFEESVRSSKRQQLQEKLLQLVQPTFQDVLGHLRAGALENFKNAFEKALDAGEGFSSSAKSCAQSCISKFDKGCEEAVIEQAKWDTSKTREKLERDIEAHISSVRTAKLAELTTLYESKLNVALSGPVEALLDGANDETWPAIRKLLRREGELAVYGLSNALSGFEMDEETRSKMLADLENYARGIVETKAKEEAGRAMMRMKDRFATIFSHDSDSMPRVWTGKEDIRAITKMARSASLKLLSVMAVIRLDDELDNIEKTLTLALFNSTGNNATSKSISTIDSLASSTWEKVAPEKTLITPVQCKSLWRQFKNETEYTVTQAISAQEANRRNNNWLPPPWAILALVVLGFNEFMTLLRNPLWLLVLFVGYLVSKALWVQLNISGEFQNGVLPGLLSLSTKFIPTVMNLLKKLAEEGQAPPTNSNQSMNSTAQSEVTTNGESSSSSSSGSSPAKNVPIDTSA

SEQ ID NO: 929 - protein, 310 aa, Arabidopsis thaliana
MDVDVFNGWGRPRFEDESLMPPGFRFHPTDEELITYYLLKKVLDSNFSCAAISQVDLNKSEPWELPEKAKMGEKEWYFFTLRDRKYPTGLRTNRATEAGYWKATGKDREIKSSKTKSLLGMKKTLVFYKGRAPKGEKSCWVMHEYRLDGKFSYHYISSSAKDEWVLCKVCLKSGVVSRETNLISSSSSSAVTGEFSSAGSAIAPIINTFATEHVSCFSNNSAAHTDASFHTFLPAPPPSLPPRQPRHVGDGVAFGQFLDLGSSGQIDFDAAAAAFFPNLPSLPPTVLPPPPSFAMYGGGSPAVSVWPFTL

SEQ ID NO: 930 - protein, 1311 aa, Arabidopsis thaliana
MGRLDVAAAKRAYRKAEEVGDRREQARWANNVGDILKNHGEYVDALKWFRIDYDISVKYLPGKDLLPTCQSLGEIYLRLENFEEALIYQKKHLQLAEEANDTVEKQRACTQLGRTYHEMFLKSEDDCEAIQSAKKYFKKAMELAQILKEKPPPGESSGFLEEYINAHNNIGMLDLDLDNPEAARTILKKGLQICDEEEVREYDAARSRLHHNLGNVFMALRSWDEAKKHIEMDINICHKINHVQGEAKGYINLAELHNKTQKYIDALLCYGKASSLAKSMQDESALVEQIEHNTKIVKKSMKVMEELREEELMLKKLSAEMTDAKGTSEERKSMLQVNACLGSLIDKSSMVFAWLKHLQYSKRKKKISDELCDKEKLSDAFMIVGESYQNLRNFRKSLKWFIRSYEGHEAIGNLEGQALAKINIGNGLDCIGEWTGALQAYEEGYRIALKANLPSIQLSALEDIHYIHMMRFGNAQKASELKETIQNLKESEHAEKAECSTQDECSETDSEGHANVSNDRPNACSSPQTPNSLRSERLADLDEANDDVPLISFLQPGKRLFKRKQVSGKQDADTDQTKKDFSVVADSQQTVAGRKRIRVILSDDESETEYELGCPKDSSHKVLRQNEEVSEESMYFDGAINYTDNRAIQDNVEEGSCSYTPLHPIKVAPNVSNCRSLSNNIAVETTGRRKKGSQCDVGDSNGTSCKTGAALVNFHAYSKTEDRKIKIEIENEHIALDSCSHDDESVKVELTCLYYLQLPDDEKSKGLLPIIHHLEYGGRVLKPLELYAILRDSSENVVIEASVDGWVHKRLMKLYMDCCQSLSEKPSMKLLKKLYISEVEDDINVSECELQDISAAPLLCALHVHNIAMLDLSHNMLGNGTMEKLKQLFASSSQMYGALTLDLHCNRFGPTALFQICECPVLFTRLEVLNVSRNRLTDACGSYLSTIVKNCRALYSLNVEHCSLTSRTIQKVANALDSKSGLSQLCIGYNNPVSGSSIQNLLAKLATLSSFAELSMNGIKLSSQVVDSLYALVKTPSLSKLLVGSSGIGTDGAIKVTESLCYQKEETVKLDLSCCGLASSFFIKLNQDVTLTSSILEFNVGGNPITEEGISALGELLRNPCSNIKVLILSKCHLKLAGLLCIIQALSDNKNLEELNLSDNAKIEDETVFGQPVKERSVMVEQEHGTCKSVTSMDKEQELCETNMECDDLEVADSEDEQIEEGTATSSSLSLPRKNHIVKELSTALSMANQLKILDLSNNGFSVEALETLYMSWSSSSSRTGIAQRHVKEETVHFYVEGKMCCGVKSCCRKD

SEQ ID NO: 931 - protein, 243 aa, Arabidopsis thaliana
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 932 - protein, 420 aa, Arabidopsis thaliana
MANVISISHFTLLALPYLLLLLSSTAAAINVTAVLSSFPNLSSFSNLLVSSGIAAELSGRNSLTLLAVPNSQFSSASLDLTRRLPPSALADLLRFHVLLQFLSDSDLRRIPPSGSAVTTLYEASGRTFFGSGSVNVTRDPASGSVTIGSPATKNVTVLKLLETKPPNITVLTVDSLIVPTGIDITASETLTPPPTSTSLSPPPAGINLTQILINGHNFNVALSLLVASGVITEFENDERGAGITVFVPTDSAFSDLPSNVNLQSLPAEQKAFVLKFHVLHSYYTLGSLESITNPVQPTLATEEMGAGSYTLNISRVNGSIVTINSGVVLAVVTQTAFDQNPVSVFGVSKVLLPKELFPKSGQPVATAPPQEISLSPESSSEQPSRLVSPPREIVSSGAVKRPLGFLVLWCWCIAFCYVLV

SEQ ID NO: 933 - protein, 545 aa, Arabidopsis thaliana
MILGLLEGIPTMHKGEIAMFKMKPEMHYAEIDCPVSAPENFPKDDELHFEIELLDFSKAKIASDDLGVIKKILNEGEGWESPREPYEVKARISAKSGDGHVIFSHTEEPYFFTFGKSEVPKGLEIGIGTMARKEKAVIYVRKQYLTESPLLHIDQDLEEVHFEVELVHFIQVRDMLGDGRLIKRRIRDGRGEFPMDCPLQDSRLSVHYKGMLLNEEKTVFYDSKIDNNDQPLEFSSGEGLVPEGFEMCTRLMLPGEIALVTCPPDYAYDKFPRPPGVSEGAHVQWEIELLGFETPRDWTGLNFQSIMDEADKIRSTGNRLFKEGKFELAKAKYEKVLREFNHVNPQDEDEGKIFGDTRNMLHLNVAACLLKMGEWRKSIETCNKVLEAKPGHVKGLYRRGMAYIAGGEYDDARNDFNMMIKVDKSSEADATAALLKLKQKEQEAESKARKQFKGLFDKRPGEITEVGSEIREESKTIEEVDETKDNDDDETLEEEGATTVSTERKRKWSEKAWPFLKNVMLQIGIQLGVVLIGILIFQFVSAKFT

SEQ ID NO: 934 - protein, 653 aa, Arabidopsis thaliana
MAESGDFNGGQPPPHSPLRTTSSGSSSSNNRGPPPPPPPPLVMVRKRLASEMSSNPDYNNSSRPPRRVSHLLDSNYNTVTPQQPPSLTAAATVSSQPNPPLSVCGFSGLPVFPSDRGGRNVMMSVQPMDQDSSSSSASPTVWVDAIIRDLIHSSTSVSIPQLIQNVRDIIFPCNPNLGALLEYRLRSLMLLDPSSSSDPSPQTFEPLYQISNNPSPPQQQQQHQQQQQQHKPPPPPIQQQERENSSTDAPPQPETVTATVPAVQTNTAEALRERKEEIKRQKQDEEGLHLLTLLLQCAEAVSADNLEEANKLLLEISQLSTPYGTSAQRVAAYFSEAMSARLLNSCLGIYAALPSRWMPQTHSLKMVSAFQVFNGISPLVKFSHFTANQAIQEAFEKEDSVHIIDLDIMQGLQWPGLFHILASRPGGPPHVRLTGLGTSMEALQATGKRLSDFADKLGLPFEFCPLAEKVGNLDTERLNVRKREAVAVHWLQHSLYDVTGSDAHTLWLLQRLAPKVVTVVEQDLSHAGSFLGRFVEAIHYYSALFDSLGASYGEESEERHVVEQQLLSKEIRNVLAVGGPSRSGEVKFESWREKMQQCGFKGISLAGNAATQATLLLGMFPSDGYTLVDDNGTLKLGWKDLSLLTASAWTPRS

SEQ ID NO: 935 - protein, 501 aa, Arabidopsis thaliana
MLLQNFSNTIFLLCLFFTLLSATKPLNLTLPHQHPSPDSVALHVIRSVNESLARRQLSSPSSSSSSSSSSSSSSCRTGNPIDDCWRCSDADWSTNRQRLADCSIGFGHGTLGGKNGKIYVVTDSSDNNPTNPTPGTLRYGVIQEEPLWIVFSSNMLIRLKQELIINSYKTLDGRGSAVHITGNGCLTLQYVQHIIIHNLHIYDCKPSAGFEKRGRSDGDGISIFGSQKIWVDHCSMSHCTDGLIDAVMGSTAITISNNYFTHHDEVMLLGHDDNYAPDTGMQVTIAFNHFGQGLVQRMPRCRRGYIHVVNNDFTEWKMYAIGGSGNPTINSQGNRYSAPSDPSAKEVTKRVDSKDDGEWSNWNWRTEGDLMENGAFFVASGEGMSSMYSKASSVDPKAASLVDQLTRNAGVFGGPRDDQGQSGNSYSPYGGDGGGGGSSGGSSGGGMDVMGGTTRGSSSSSGDDSNVFQMIFGSDAPSRPRLTLLFSLLMISVLSLSTLLL

SEQ ID NO: 936 - protein, 170 aa, Arabidopsis thaliana
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 937 - protein, 198 aa, Arabidopsis thaliana
MIVLSVGSASSSPIVVVFSVALLLFYFSETSLGAPCPINGLPIVRNISDLPQDNYGRPGLSHMTVAGSVLHGMKEVEIWLQTFAPGSETPIHRHSCEEVFVVLKGSGTLYLAETHGNFPGKPIEFPIFANSTIHIPINDAHQVKNTGHEDLQVLVIISRPPIKIFIYEDWFMPHTAARLKFPYYWDEQCIQESQKDEL

SEQ ID NO: 938 - protein, 587 aa, Arabidopsis thaliana
MDLFKILLLVFFVNISFCFAADPYSFYNFEVSYITASPLGVPQQVIAINGKFPGPTINVTTNENLVVNVRNKLDEGLLLHWNGIQQRRVSWQDGVLGTNCPIPPKWNWTYEFQVKDQIGSFFYFPSLHFQRASGGFGSFVVNPRAIIPVPFSTPDGDITVTIGDWYIRNHTALRKALDDGKDLGMPDGVLINGKGPYRYNDTLVADGIDFETITVHPGKTYRLRVSNVGISTSLNFRIQGHNLVLAESEGSYTVQQNYTSLDIHVGQSYSFLVTMDQNASSDYYIVASARVVNETIWRRVTGVGILKYTNSKGKAKGQLPPGPQDEFDKTFSMNQARSIRWNVSASGARPNPQGSFKYGSINVTDVYVLRNMPPVTISGKRRTTLNGISFKNPSTPIRLADKLKVKDVYKLDFPKRPLTGPAKVATSIINGTYRGFMEVVLQNNDTKMQSYHMSGYAFFVVGMDYGEWTENSRGTYNKWDGIARSTIQVYPGAWSAILISLDNPGAWNLRTENLDSWYLGQETYVRVVNPDENNKTEFGHPDNVLYCGALSKLQKPQKVSSSASKSIGFTSLSMVVMALVMMMMLQH

SEQ ID NO: 939 - protein, 380 aa, Arabidopsis thaliana
MADDKEMPAAVVDGHDQVTGHIISTTIGGKNGEPKQTISYMAERVVGTGSFGIVFQAKCLETGETVAIKKVLQDRRYKNRELQLMRVMDHPNVVCLKHCFFSTTSKDELFLNLVMEYVPESLYRVLKHYSSANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAGSSPELVNKLIPDHIKRQLGLSFLNQSGT

SEQ ID NO: 940 - protein, 775 aa, Arabidopsis thaliana
MADRRNRCNQILLLAYQSFGLVFGDLSISPLYVYKCTFYGGLRHHQTEDTIFGAFSLIFWTITLLSLIKYMVFVLSADDNGEGGIFALYALLCRHARFSLLPNQQAADEEISTYYGPGDASRNLPSSAFKSLIERNKRSKTALLVLVLVGTSMVITIGVLTPAISVSSSIDGLVAKTSLKHSTVVMIACALLVGLFVLQHRGTNKVAFLFAPIMILWLLIIATAGVYNIVTWNPSVYKALSPYYIYVFFRDTGIDGWLSLGGILLCITGTEAIFAELGQFTATSIRFAFCCVVYPCLVLQYMGQAAFLSKNFSALPSSFYSSIPDPFFWPVLMMAMLAAMVASQAVIFATFSIVKQCYALGCFPRVKIVHKPRWVLGQIYIPEINWVVMILTLAVTICFRDTRHIAFAFGLACMTLAFVTTWLMPLIINFVWNRNIVFSVLFILFFGTIELIFVASALVKIPKGGWITLLLSLFFTFITYVWHYGSRKKYLCDQHNKVPMKSILSLGPSLGIIKVPGMGLIYTELASGVPATFKHFLTNLPAFYQVVVFVCCKTVPIPYVPQKERYLIGRIGPKTYRMYRCIIRAGYKDVNKDGDDFEDELVMSIAEFIQLESEGYGGSNTDRSIDGRLAVVKASNKFGTRLSRSISEANIAGSSRSQTTVTNSKSPALLKLRAEYEQELPRLSMRRMFQFRPMDTKFRQPQVKEELFDLVNAKDAEVAYIVGHGHVKAKRNSVFVKQLVVNVAYSFLRKNCRSPGVMLNIPHICLIKVGMNYYL

SEQ ID NO: 941 - protein, 465 aa, Arabidopsis thaliana
MARTHFIFLLLVALLSTTFPSSSSSREQEKDRIKALPGQPKVAFSQYSGYVNVNQSHGRALFYWLTESSSPSPHTKPLLLWLNGGPGCSSIAYGASEEIGPFRINKTGSNLYLNKFAWNKDANLLFLESPAGVGYSYTNTSSDLKDSGDERTAQDNLIFLIKWLSRFPQYKYRDFYIAGESYAGHYVPQLAKKINDYNKAFSKPIINLKGFLVGNAVTDNQYDSIGTVTYWWTHAIISDKSYKSILKYCNFTVERVSDDCDNAVNYAMNHEFGDIDQYSIYTPTCVAAQQKKNTTGFFVRMKNTLLRRRLVSGYDPCTESYAEKYFNRPDVQRAMHANVTGIRYKWTACSDVLIKTWKDSDKTMLPIYKELAASGLRIWIFSGDTDSVVPVTATRFSLSHLNLPVKTRWYPWYTDNQVGGWTEVYKGLTFATVRGAGHEVPLFEPKRALILFRSFLAGKELPRSY

SEQ ID NO: 942 - protein, 833 aa, Arabidopsis thaliana
MGGGSNNSHNMDNGKYVRYTPEQVEALERLYNDCPKPSSMRRQQLIRECPILSNIEPKQIKVWFQNRRCREKQRKEASRLQAVNRKLTAMNKLLMEENDRLQKQVSHLVYENSYFRQHPQNQGNLATTDTSCESVVTSGQHHLTPQHQPRDASPAGLLSIADETLTEFISKATGTAVEWVQMPGMKPGPDSIGIVAISHGCTGIAARACGLVGLDPTRVAEILKDKPCWLRDCRSLDIVNVLSTANGGTLELIYMQLYAPTTLAPARDFWMLRYTSVMEDGSLVICERSLNNTQNGPSMPPSPHFVRAEILPSGYLIRPCEGGGSILHIVDHFDLEPWSVPEVLRSLYESSTLLAQRTTMAALRYLRQISQEISQPNVTGWGRRPAALRALSQRLSKGFNEAVNGFSDEGWSILESDGIDDVTLLVNSSPTKMMMTSSLPFANGYTSMPSAVLCAKASMLLQNVPPSILLRFLREHRQEWADNSIDAYSAAAIKAGPCSLPIPRPGSFGGQVILPLAHTIENEEFMEVIKLESLGHYQEDMMMPADIFLLQMCSGVDENAVESCAELIFAPIDASFSDDAPIIPSGFRIIPLDSKSEGLSPNRTLDLASALDVGSRTAGDSCGSRGNSKSVMTIAFQLAFEMHMQENVASMARQYVRSVIASVQRVALALSPSSHQLSGLRPPPASPEAHTLARWISHSYRCYLGVDLLKPHGTDLLKSLWHHPDAVMCCSLKALSPVFTFANQAGLDMLETTLVALQDITLDKIFDNNNGKKTLSSEFPQIMQQGFMCMDGGICMSSMGRAVTYEKAVGWKVLNDDEDPHCICFMFLNWSFI

SEQ ID NO: 943 - protein, 476 aa, Arabidopsis thaliana
MEEDLIKRLEAAVTRLEGISSNGGGVVSLSRGGDFSSAAGIDIASSDPSILAYEDLISQCVGRALTAAEKIGGPVLDVTKIVAEAFASQKELLVRIKQTQKPDLAGLAGFLKPLNDVTMKANAMTEGKRSDFFNHLKAACDSLSALAWIAFTGKDCGMSMPIAHVEESWQMAEFYNNKVLVEYRNKDADHVEWAKALKELYLPGLREYVKSHYPLGPVWNASGKPASAPAKGPPGAPAPPPAPLFSAESSKPSSSSNQKQGMSAVFQQLSSGAVTSGLRKVTDDMKTKNRADRSGAVSAVEKETRTSKPAFSKTGPPKMELQMGRKWAVENQIGKKDLVISECDSKQSVYIYGCKDSVLQIQGKVNNITIDKCTKVGVVFTDVVAAFEIVNCNNVEVQCQGSAPTVSVDNTTGCQLYLNKDSLETAITTAKSSEINVMVPGATPDGDWVEHALPQQYNHVFTEGKFETTPVSHSGA

SEQ ID NO: 944 - protein, 524 aa, Arabidopsis thaliana
MQPPASAGLFRSPENLPWPYNYMDYLVAGFLVLTAGILLRPWLWLRLRNSKTKDGDEEEDNEEKKKGMIPNGSLGWPVIGETLNFIACGYSSRPVTFMDKRKSLYGKVFKTNIIGTPIIISTDAEVNKVVLQNHGNTFVPAYPKSITELLGENSILSINGPHQKRLHTLIGAFLRSPHLKDRITRDIEASVVLTLASWAQLPLVHVQDEIKKMTFEILVKVLMSTSPGEDMNILKLEFEEFIKGLICIPIKFPGTRLYKSLKAKERLIKMVKKVVEERQVAMTTTSPANDVVDVLLRDGGDSEKQSQPSDFVSGKIVEMMIPGEETMPTAMTLAVKFLSDNPVALAKLVEENMEMKRRKLELGEEYKWTDYMSLSFTQNVINETLRMANIINGVWRKALKDVEIKGYLIPKGWCVLASFISVHMDEDIYDNPYQFDPWRWDRINGSANSSICFTPFGGGQRLCPGLELSKLEISIFLHHLVTRYSWTAEEDEIVSFPTVKMKRRLPIRVATVDDSASPISLEDH

SEQ ID NO: 945 - protein, 1196 aa, Arabidopsis thaliana
MKTFSSFFLSVTTLFFFSFFSLSFQASPSQSLYREIHQLISFKDVLPDKNLLPDWSSNKNPCTFDGVTCRDDKVTSIDLSSKPLNVGFSAVSSSLLSLTGLESLFLSNSHINGSVSGFKCSASLTSLDLSRNSLSGPVTTLTSLGSCSGLKFLNVSSNTLDFPGKVSGGLKLNSLEVLDLSANSISGANVVGWVLSDGCGELKHLAISGNKISGDVDVSRCVNLEFLDVSSNNFSTGIPFLGDCSALQHLDISGNKLSGDFSRAISTCTELKLLNISSNQFVGPIPPLPLKSLQYLSLAENKFTGEIPDFLSGACDTLTGLDLSGNHFYGAVPPFFGSCSLLESLALSSNNFSGELPMDTLLKMRGLKVLDLSFNEFSGELPESLTNLSASLLTLDLSSNNFSGPILPNLCQNPKNTLQELYLQNNGFTGKIPPTLSNCSELVSLHLSFNYLSGTIPSSLGSLSKLRDLKLWLNMLEGEIPQELMYVKTLETLILDFNDLTGEIPSGLSNCTNLNWISLSNNRLTGEIPKWIGRLENLAILKLSNNSFSGNIPAELGDCRSLIWLDLNTNLFNGTIPAAMFKQSGKIAANFIAGKRYVYIKNDGMKKECHGAGNLLEFQGIRSEQLNRLSTRNPCNITSRVYGGHTSPTFDNNGSMMFLDMSYNMLSGYIPKEIGSMPYLFILNLGHNDISGSIPDEVGDLRGLNILDLSSNKLDGRIPQAMSALTMLTEIDLSNNNLSGPIPEMGQFETFPPAKFLNNPGLCGYPLPRCDPSNADGYAHHQRSHGRRPASLAGSVAMGLLFSFVCIFGLILVGREMRKRRRKKEAELEMYAEGHGNSGDRTANNTNWKLTGVKEALSINLAAFEKPLRKLTFADLLQATNGFHNDSLIGSGGFGDVYKAILKDGSAVAIKKLIHVSGQGDREFMAEMETIGKIKHRNLVPLLGYCKVGDERLLVYEFMKYGSLEDVLHDPKKAGVKLNWSTRRKIAIGSARGLAFLHHNCSPHIIHRDMKSSNVLLDENLEARVSDFGMARLMSAMDTHLSVSTLAGTPGYVPPEYYQSFRCSTKGDVYSYGVVLLELLTGKRPTDSPDFGDNNLVGWVKQHAKLRISDVFDPELMKEDPALEIELLQHLKVAVACLDDRAWRRPTMVQVMAMFKEIQAGSGIDSQSTIRSIEDGGFSTIEMVDMSIKEVPEGKL

SEQ ID NO: 946 - protein, 294 aa, Arabidopsis thaliana
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 947 - protein, 153 aa, Arabidopsis thaliana
MRDRMERLVVLPFSIGCISVSSVAVLSPLSKPHHHHSRQVIREQEEEDNMKNVFKFLAVSKPEISIGINRIFKSFKTISQLFADKDEEKEEVETSGMEIGVPTNVKHVSHIGWESGLTAATGPGKGWEDLIPPELLAAAASKKEINPHLHPTL

SEQ ID NO: 948 - protein, 480 aa, Arabidopsis thaliana
MYSGSSDGESHDTSTQRKIPPASSMLWVRNLRRYIGSGAGLGSEALMELETKRILLEIFKEKQQKSQEAGTIPSFYKKKPEEGSISQRVQKLAKYRFLKKQSDLLLNADDLAAMWVCLRENCVIDDATGAEKMNYEDFCHIASVCTEQIGPKCRRFFSPSNFMKFEKDEAGRIAILPFYLYVMRTVSLTQARIDMSELDEDSDGFLHSDEMESYIGGLIPNLAQLRDMPPAFNQMYCRIASQKFFFFCDPHRRGRACIKKILLSNCLQELMELHQESEEEVTDTEQAENWFSLTSAQRICDMFLALDKDMSGSLCKQELKEYADGTLTEIFIERVFDEHVRRGKIVAGNSREMDFDSFLDFVLALENKDTPEGLTYLFRCLDLQGRGFLTTADIHSLFRDVHQKWIEGGNYELCIEDVRDEIWDMVKPSDPLKITLGDLLGCKQGGTVASMLIDVRGFWAHDNRENLLQEEEEPPEEESQ

SEQ ID NO: 949 - protein, 581 aa, Arabidopsis thaliana
MAMIGMNIIGLFMVLMLLLISLIILFACKPWRYFSRFRSSSRFSSTFKVGDLQRPLISDDGNLIQGQTSEVTREYDLEGACYQNDGLLHSSLTEGRFYKQRLPSSSPHFSQGESFVLEVISEPSDNALVGQTLKLPAEKGSLAEVQTYDWQNNRNENLQYNLEKDRLINLSPRLVEDQRSWLFLEVIAGPAIGLQHAVNSTSSSKLPVKLGRVSPSDLALKDSEVSGKHAQITWNSTKFKWELVDMGSLNGTLVNSHSISHPDLGSRKWGNPVELASDDIITLGTTTKVYVRISSQNEFQIPFKIGVASDPMAMRRGGRKLPMEDVCHYKWPLPGANKFGLFCVCDGHGGSGAAQSAIKIIPEVLANILSDSLRKEKVLSKRDASDVLRDMFAKTEARLEEHQYEGCTATVLLVWKDNEENFFAQCANLGDSACVIHLGGRYIQMTEDHRVVSLSERKRFQEAGLALRDGETRLFGINLARMLGDKFPKQQDSRFSAEPYISEPLRIDQSSKDVFAVLASDGLWDVVSPKKAVQLVLQMRDKERGRESSAEKIANGLLNEARAMRTKDNTSIIYLDFDTSL

SEQ ID NO: 950 - protein, 620 aa, Arabidopsis thaliana
MSSEIEVVEEIQSNPKENGESSSKGIEEESLKNDVYTAAAYGDLEKLHRLVECEGSSVSEPDALGYYALQWSALNNRVAVAQYLIEHGGDVNATDHTGQTALHWSAVRGAIQVAELLLQEGARVDATDMYGYQATHVAAQYGQTAFLCHVVSKWNADPDVPDNDGRSPLHWAAYKGFADSIRLLLFLDAYRGRQDKEGCTPLHWAAIRGNLEACTVLVQAGKKEDLMITDKTGLTPAQLAAEKNHRQVSFFLGNARSLLEKRCDGSSPLGRLSKLGLAPVLWIMILLLLLVYTNSVVLASNLPKLTTGIGALAWLGFILATAGLFLFYRCSRKDPGYIRMNIHDPQTMKDDEPLLKIELNNPALLAGNWTQLCATCKIIRPLRAKHCSTCDRCVEQFDHHCPWVSNCVGKKNKWEFFLFLLLEVLAMLITGGVTLARVLSDPSAPSSFGAWMSHVASNHVGALSFLLVEFCLFFSVAVLTVIQASQISRNITTNEMANALRYSYLRGPGGRFRNPYDLGCRRNCSDFLVKGYNEDIECHEEDATQRPEGISMMQMQRNPNLQNGNGHVAIDVNPTHNSQSAHVHSANCSHSHNSKSKSDNVPLGLGLGLSRNPTRPVVSP

SEQ ID NO: 951 - protein, 308 aa, Arabidopsis thaliana
MVTYVSALFYGFGGIVVAGVALLVAFQEKLVYVPVLPGLSKSYPITPARLNLIYEDIWLQSSDGVRLHAWFIKMFPECRGPTILFFQENAGNIAHRLEMVRIMIQKLKCNVFMLSYRGYGASEGYPSQQGIIKDAQAALDHLSGRTDIDTSRIVVFGRSLGGAVGAVLTKNNPDKVSALILENTFTSILDMAGVLLPFLKWFIGGSGTKSLKLLNFVVRSPWKTIDAIAEIKQPVLFLSGLQDEMVPPFHMKMLYAKAAARNPQCTFVEFPSGMHMDTWLSGGEVYWKTNLQFLEKYAPEKRKEDTGR

SEQ ID NO: 952 - protein, 1150 aa, Arabidopsis thaliana
MKAPSSNGVSPNPVEGERRNINSELWHACAGPLISLPPAGSLVVYFPQGHSEQVAASMQKQTDFIPSYPNLPSKLICMLHNVTLNADPETDEVYAQMTLQPVNKYDRDALLASDMGLKLNRQPNEFFCKTLTASDTSTHGGFSVPRRAAEKIFPALDFSMQPPCQELVAKDIHDNTWTFRHIYRGQPKRHLLTTGWSVFVSTKRLFAGDSVLFIRDGKAQLLLGIRRANRQQPALSSSVISSDSMHIGVLAAAAHANANNSPFTIFYNPRWAAPAEFVVPLAKYTKAMYAQVSLGMRFRMIFETEECGVRRYMGTVTGISDLDPVRWKNSQWRNLQIGWDESAAGDRPSRVSVWDIEPVLTPFYICPPPFFRPRFSGQPGMPDDETDMESALKRAMPWLDNSLEMKDPSSTIFPGLSLVQWMNMQQQNGQLPSAAAQPGFFPSMLSPTAALHNNLGGTDDPSKLLSFQTPHGGISSSNLQFNKQNQQAPMSQLPQPPTTLSQQQQLQQLLHSSLNHQQQQSQSQQQQQQQQLLQQQQQLQSQQHSNNNQSQSQQQQQLLQQQQQQQLQQQHQQPLQQQTQQQQLRTQPLQSHSHPQPQQLQQHKLQQLQVPQNQLYNGQQAAQQHQSQQASTHHLQPQLVSGSMASSVITPPSSSLNQSFQQQQQQSKQLQQAHHHLGASTSQSSVIETSKSSSNLMSAPPQETQFSRQVEQQQPPGLNGQNQQTLLQQKAHQAQAQQIFQQSLLEQPHIQFQLLQRLQQQQQQQFLSPQSQLPHHQLQSQQLQQLPTLSQGHQFPSSCTNNGLSTLQPPQMLVSRPQEKQNPPVGGGVKAYSGITDGGDAPSSSTSPSTNNCQISSSGFLNRSQSGPAILIPDAAIDMSGNLVQDLYSKSDMRLKQELVGQQKSKASLTDHQLEASASGTSYGLDGGENNRQQNFLAPTFGLDGDSRNSLLGGANVDNGFVPDTLLSRGYDSQKDLQNMLSNYGGVTNDIGTEMSTSAVRTQSFGVPNVPAISNDLAVNDAGVLGGGLWPAQTQRMRTYTKVQKRGSVGRSIDVNRYRGYDELRHDLARMFGIEGQLEDPQTSDWKLVYVDHENDILLVGDDPWEEFVNCVQSIKILSSAEVQQMSLDGNFAGVPVTNQACSGATSFNR

SEQ ID NO: 953 - protein, 218 aa, Arabidopsis thaliana
MIASESTKSWEASAVRQENEEEKKKPVKDSGKHPVYRGVRKRNWGKWVSEIREPRKKSRIWLGTFPSPEMAARAHDVAALSIKGASAILNFPDLAGSFPRPSSLSPRDIQVAALKAAHMETSQSFSSSSSLTFSSSQSSSSLESLVSSSATGSEELGEIVELPSLGSSYDGLTQLGNEFIFSDSADLWPYPPQWSEGDYQMIPASLSQDWDLQGLYNY

SEQ ID NO: 954 - protein, 405 aa, Arabidopsis thaliana
MASVGIAPNPGARDSTGVDKLPEEMNDMKIRDDKEMEATVVDGNGTETGHIIVTTIGGRNGQPKQTISYMAERVVGHGSFGVVFQAKCLETGETVAIKKVLQDRRYKNRELQTMRLLDHPNVVSLKHCFFSTTEKDELYLNLVLEYVPETVHRVIKHYNKLNQRMPLIYVKLYTYQIFRALSYIHRCIGVCHRDIKPQNLLVNPHTHQVKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPPEAVDLVSRLLQYSPNLRSAALDTLVHPFFDELRDPNARLPNGRFLPPLFNFKPHELKGVPLEMVAKLVPEHARKQCPWLGL

SEQ ID NO: 955 - protein, 221 aa, Arabidopsis thaliana
MSDVFDGYERQYCELSASLSKKCSSAISLDGEQKKQKLSEIKSGLENAEVLIRKMDLEARTLPPNLKSSLLVKLREFKSDLNNFKTEVKRITSGQLNAAARDELLEAGMADTKTASADQRARLMMSTERLGRTTDRVKDSRRTMMETEEIGVSILQDLHGQRQSLLRAHETLHGVDDNIGKSKKILTDMTRRMNKNKWTIGAIIIALIAAIFIILYFKLTK

SEQ ID NO: 956 - protein, 621 aa, Arabidopsis thaliana
MYGRDPWGGPLEINTADSATDDDRSRNLNDLDRAALSRPLDETQQSWLLGPTEQKKKKYVDLGCIIVSRKIFVWTVGTLVAAALLAGFITLIVKTVPRHHPKTPPPDNYTIALHKALKFFNAQKSGKLPKHNNVSWRGNSGLQDGKGETGSFYKDLVGGYYDAGDAIKFNFPMAYAMTMLSWSVIEYSAKYEAAGELTHVKELIKWGTDYFLKTFNSTADSIDDLVSQVGSGNTDDGNTDPNDHYCWMRPEDMDYKRPVTTCNGGCSDLAAEMAAALASASIVFKDNKEYSKKLVHGAKVVYQFGRTRRGRYSAGTAESSKFYNSSMYWDEFIWGGAWMYYATGNVTYLNLITQPTMAKHAGAFWGGPYYGVFSWDNKLAGAQLLLSRLRLFLSPGYPYEEILRTFHNQTSIVMCSYLPIFNKFNRTNGGLIELNHGAPQPLQYSVNAAFLATLYSDYLDAADTPGWYCGPNFYSTSVLRDFARSQIDYILGKNPRKMSYVVGFGTKYPRHVHHRGASIPKNKVKYNCKGGWKWRDSKKPNPNTIEGAMVAGPDKRDGYRDVRMNYNYTEPTLAGNAGLVAALVALSGEEEATGKIDKNTIFSAVPPLFPTPPPPPAPWKP

SEQ ID NO: 957 - protein, 220 aa, Arabidopsis thaliana
MALELWQTLKEAIHAYTGLSPVVFFTALALAFAIYQVISGWFASPFDDVNRHQRARSLAQEEEPPIPQPVQVGEITEEELKQYDGSDPQKPLLMAIKHQIYDVTQSRMFYGPGGPYALFAGKDASRALAKMSFEEKDLTWDVSGLGPFELDALQDWEYKFMSKYAKVGTVKVAGSEPETASVSEPTENVEQDAHVTTTPGKTVVDKSDDAPAETVLKKEE

SEQ ID NO: 958 - protein, 375 aa, Arabidopsis thaliana [sequence omitted]

SEQ ID NO: 959 - protein, 1168 aa, Arabidopsis thaliana
MSTTEPSPENDRDPQPTTISTPTSTNAKLLKKIPAIPFRHSDKEGEDEQAKTDEVTTELAGEGPMSHDSPEILAPSSLGLNHIRTKSSPAPSPLRFSSATPLISPGQDDKDVAKEKPRVGVVDARADARARWPIPPHQPDQGKKVQWSQSKSQRVPANSNPGVESTHVGLAKETQSPRFQAILRVTSGRKKKAHDIKSFSHELNSKGVRPFPVWRSRAVGHMEEIMAAIRTKFDKQKEDVDADLGVFAGYLVTTLESTPESNKELRVGLEDLLVEARQCATMPASEFWLKCEGIVQKLDDKRQELPMGGLKQAHNRLLFILTRCNRLVQFRKESGYVEEHILGMHQLSDLGVYPEQMVEISRQQDLLREKEIQKINEKQNLAGKQDDQNSNSGADGVEVNTARSTDSTSSNFRMSSWKKLPSAAEKNRSLNNTPKAKGESKIQPKVYGDENAENLHSPSGQPASADRSALWGFWADHQCVTYDNSMICRICEVEIPVVHVEEHSRICTIADRCDLKGINVNLRLERVAESLEKILESWTPKSSVTPRAVADSARLSNSSRQEDLDEISQRCSDDMLDCVPRSQNTFSLDELNILNEMSMTNGTKDSSAGSLTPPSPATPRNSQVDLLLSGRKTISELENYQQINKLLDIARSVANVNVCGYSSLDFMIEQLDELKYVIQDRKADALVVETFGRRIEKLLQEKYIELCGLIDDEKVDSSNAMPDEESSADEDTVRSLRASPLNPRAKDRTSIEDFEIIKPISRGAFGRVFLAKKRATGDLFAIKVLKKADMIRKNAVESILAERNILISVRNPFVVRFFYSFTCRENLYLVMEYLNGGDLFSLLRNLGCLDEDMARIYIAEVVLALEYLHSVNIIHRDLKPDNLLINQDGHIKLTDFGLSKVGLINSTDDLSGESSLGNSGFFAEDGSKAQHSQGKDSRKKHAVVGTPDYLAPEILLGMGHGKTADWWSVGVILFEVLVGIPPFNAETPQQIFENIINRDIPWPNVPEEISYEAHDLINKLLTENPVQRLGATGAGEVKQHHFFKDINWDTLARQKAMFVPSAEPQDTSYFMSRYIWNPEDENVHGGSDFDDLTDTCSSSSFNTQEEDGDECGSLAEFGNGPNLAVKYSFSNFSFKNLSQLASINYDLVLKNAKESVEASNQSAPRPET

SEQ ID NO: 960 - protein, 487 aa, Arabidopsis thaliana
MKGGTIQISWHDGKPVLTVDFHPISGLLATAGADYDIKLWLINSGQAEKKVPSVSYQSSLTYHGCAVNTIRFSPSGELLASGADGGELFIWKLHPSETNQSWKVHKSLSFHRKDVLDLQWSPDDAYLISGSVDNSCIIWDVNKGSVHQILDAHCHYVQGVAWDPLAKYVASLSSDRTCRIYANKPQTKSKGVEKMNYVCQHVIMKADQQRGDETKTIKTHLFHDETLPSFFRRLSWSPDGSFLLIPAGSFKVSPTSEAVNATYVFSRKDLSRPALQLPGASKPVVVVRFCPVAFKLRGSSSEEGFFKLPYRLVFAIATLNSVYIYDTECVAPIAVLAGLHYAAITDITWSPNASYLALSSQDGYCTLVEFEDKELGEAVSISVGKKPVDGEEKKHDLEKGDELMTETTPDESKKQAELEQNEESKQPLPSKITTDGKEKEHIMQKTDDEVMTETRHEEENQPLQSKVNTPVSNKPARKRITPMAIDP

SEQ ID NO: 961 - protein, 437 aa, Arabidopsis thaliana
MVNLSRSVALISVFLLPLLSFSFSVDNPTDRRVLVLLDDLSLKSSHSIFFNTLKSRGFDLDFKLAEDSKLALQRYGQYLYDGLIIFAPSTERFGGSLDSKSIADFVDSGRDLILSADTAASDLIRGIATECGVDFDEDSSAMVIDHTSFSVSDVDGDHTLIAADDLVKSDVILGKTKIEAPVLFRGVAHSLNPTNNLVLKVLSASPSAYSANPSSKLSSPPQLTGSSISLVSVMQARNNARVVISGSVQLFSDRLIRSGVQKAGSPNQYEKSGNEQFVTELSKWVFHERGHLKAGNLVHHRVGETDEPAIYRIKDDLEFSVEIYEWSGKSWEPYVANDVQVQFYMMSPYVLKTLSTDKKGLFHTSFKVPDVYGVFQFKVEYEKLGYTTLSLSKQIPVRPYRHNEYERFIPTAYPYYGACFTTMAGFFVFSFVYLYHK

SEQ ID NO: 962 - DNA, 729 bp, Arabidopsis thaliana
atcaccattcaccactaaactacttcaatcaacttccttttcccgagaaaatcagaaagaaaattcacgatggcaccaagagccgagaagaagcccgccgagaaaaaaaccgccgctgagagaccggtggaagagaacaaggctgctgaaaaggctccggcggagaagaaacccaaggcggggaagaaattgccaccaaaggaagccggtgacaagaagaagaagcgatctaagaaaaacgtcgaaacctacaagatctacatcttcaaggtgctgaagcaggttcatccagatatcggaatttcaagcaaagccatggggattatgaacagtttcatcaacgacatattcgagaagctagctcaggaatcttcgaaactcgctaggtacaacaagaagccgaccattacatctcgcgagatccagacggctgtgagactcgtcctccccggtgaactcgctaaacacgccgtctctgaaggtaccaaggcggttaccaagtttactagctcttgaagagacccggttagggtttttagggatttcaatttcggtttggtttttagtacttgtaggaaattagatgcattattcgcttaacttcgtattttgtggctttgtaactctaggaagtagagaagattgttccttccttttatgaatttcaatgttggattatatatttttaacgatttttttttccatttcaatttcatttacctaatcact

SEQ ID NO: 963 - DNA, 607 bp, Arabidopsis thaliana
atccagatctcaactttctctcatcttcaaattaaaatcaaacagtttcttaataacattttacttcatggctcgtaccaagcagacggctaggaaatcaaccggaggaaaggctccaaggaagcagctggcgacaaaagcggcgaggaaatctgctccggccaccggaggagtgaagaagccacacagattcagacccggaactgttgctttaagagaaatcaggaagtaccagaagagcactgagcttcttatccgtaaactccctttccagaggcttgtcagagagatcgctcaggacttcaaaaccgatcttcgtttccagagcagtgccgtcgccgctcttcaggaagctgctgaagcttacctcgtcggactcttcgaagacaccaatctctgcgccattcacgccaagagggtcacgatcatgcccaaggacatccagctcgcgagaagaatcagaggagaacgagcttagatctaagtattctggttactcttgtgttttgattagaaccataagattgtaaaatttcaagttaaatccaagggttataatattaattccaagcaattatcttttgttctatcaaagtattgacttttt

SEQ ID NO: 964 - DNA, 4136 bp, Arabidopsis thaliana; identical to SEQ ID NO: 272

SEQ ID NO: 965 - DNA, 878 bp, Arabidopsis thaliana
tcactgtctacaaaatcattgaagatctacccaaaaaaaaaaaaaaagagatggttctgctagagaagctttgggatgatgttgtggctggacctcagcctgaccgtggccttggccgcctccgtaagatcaccacccaacccattaatatccgagatataggagaagggagcagcagtaaggtggtgatgcataggtcgttgaccatgccggcggcagtgagccctggaactccaacgactccaaccactccgacgacgccacgtaaggataacgtgtggaggagcgtctttaatccgggaagcaacctcgccactagagccatcggctccaacatctttgataaacccacccatccaaattctccctccgtctacgactgcgttgataatgaagctcaaaggaaggaacatgtggcactgtgtttagtgggcgcgtggattaagtgaatagttttattctgatttgaccaaatcaaccttcctttttgtgcatatggttgtacagcggtgactcaaggagtcagcaccgttagggatggtccgatggagtgtgacatgcgggtgatgtaaatatggtgacctgatcttccgccaccttactttgttttttttatattgtttttgtgtactttatcagagtggataaagtgacggggaatgtttttcttttgtacaaaaaactgtcttcccacctaagcaatgtgtgttagtttctgttttgggctgtgttttgcaagtttttgtatttcagagttgtgtagtgtagttgcaagtggcggttggatctttcactatcttgttggattttgatgatggttgatgcttttgctttaatgttaaataaataagcatacttttgctaggtaccattgcatc

SEQ ID NO: 966 - DNA, 674 bp, Arabidopsis thaliana
ccataacaacaaattcgattcttataactgtttccctctcatctttacacaaaagtattctaatcgatttcaatggcgggtcgtggtaaaacactcggatctgggtctgcgaagaaggcaacaacaagaagcagcaaagccggtctccaattccctgtgggtcgtatcgctcgtttcttgaagaaaggcaaatacgccgaacgtgttggtgccggagctccggtttacttagccgccgttctcgaatacctcgccgctgaggtattggaattggctggaaacgcagcgagggataacaagaagacgaggattgttccaaggcatattcaattggcggtgaggaacgatgaagaattgagcaaattgcttggagatgtgactattgctaatggaggtgtgatgcctaacattcacaatcttcttcttcctaagaagaccggtgcttccaagccatctgctgaagacgattgattaatcaaccaaatccactctcttgtgttttttgagtttttaaggctttttaagagtaatttagattagatctatggtgaagaaagaatctatcttctgtgttttttgaattgaattgaatgttcatatgctttcaatttcttatggaatcaagattttaacttttctaggttttcgagttatgatgatgaaattcttagtct

SEQ ID NO: 967 - DNA, 531 bp, Arabidopsis thaliana
aacaacattcaaaagctattagcgattcttcttctctctgattcaatcttcttcatagtttctaagctctcaagttcttgacgaagcaatggctcgtacgaagcaaactgcaagaaaatcacacggaggaaaagctccgaggactctgctcgctaccaaggcggcgaggaaatctgcgccgactactggaggagtcaagaaacctcaccgttaccgtcccggaaccgtcgctcttcgtgagattcgtaaataccagaagagcacagagttgttgatccgtaaacttccttttcaacgtcttgttcgtgaaatcgctcaagattacaagacggatctgagattccagagccatgcggtgttagctcttcaagaagctgctgaagcatatttggttggtttgtttgaagatacaaatctgtgtgccattcatgccaagagggttacgatcatgcctaaagatgttcaattggcaagaaggattcgtggagagcgtgcttagattcgaattaaatcatcaactattattctatt

SEQ ID NO: 968 - DNA, 785 bp, Arabidopsis thaliana
cttcgtctacatcgttctacacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtagctacggaggtggcggcggtagacgcgagggtggaggaggatacagcggcggcggcggcggttactcctcaagaggtggtggtggcggaagctacggtggtggaagacgtgagggaggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagatattatctctgttgattgattctatcatct

SEQ ID NO: 969 - DNA, 701 bp, Arabidopsis thaliana
atcttcttcatcatcatcaatcacaaaaatccaaatcccaaaactttcccgagaaaactaaaaaaatggcaccaaaagccggaaagaaaccagcagagaaaaagcccgcagagaaagctccagcagaagaagagaaagtagccgaaaaagcaccagcagagaagaaaccaaaagccggaaaaaaactaccaaaagaagcagtcaccggaggagtcgagaagaagaagaaacgagtcaagaaaagcacagagacatacaagatctacatcttcaaggtgttgaaacaagttcatccagatattggaatctcaagtaaagctatggggattatgaacagttttatcaatgatatattcgagaaacttgcgcaagaagcttcaaaattagctaggtataataagaaacctacgattacttctagggagattcagacagctgttagactagtgttacctggtgaacttgctaagcatgctgtttctgaaggaactaaggctgttactaagtttactagctcttaggtttagccgtttaggtttcgaatcttggttcgttttgatatggaatctgatggtttttatgtaatttgttgaagattgtaatggtgttaatgttttctttttaatttggattttgtgtttagtgacttgggattctacaagaagtttgatatttatgaatgttaaattaaaatttggatt

SEQ ID NO: 970 - DNA, 605 bp, Arabidopsis thaliana
acgcgtctctcaattctcacattctcaaaatcactaaaatcaaactcaattttcatcaaatatctctaatggcgccgaaagcagcggagaagaaaccggcagagaagaaaccagccgggaaagctccggcggagaaactcccaaaggcggagaagaaaatcagcaaagacgccggaggaagcgagaagaagaagaagaaatcgaagaagagcgtcgagacttacaagatctacatcttcaaggttctgaaacaagttcatccagatgttggaatctctgggaaagctatggggattatgaacagtttcatcaatgacatcttcgagaaacttgctcaggaatcgtcaaagctcgctaggtacaataagaagccgacgattacatcgagggagattcaaaccgctgtgagacttgtgttgcctggagaactcgctaaacatgcggtttctgaaggcacgaaggcggttaccaaattcaccagttagggttttcctgtaaatttccggttaagtgtttggtttagactcggtttgtttagatgttttgagtttcgtgaattgtttgatgatcactctaatggttcaaaattgatggttgaatttgat

SEQ ID NO: 971 - DNA, 619 bp, Arabidopsis thaliana
aaaaagagagaaaaacacaattaaaaattattatgaagaggaacggcgagacgaaacggcggaggaacgtggcggaggaggcagagcagggagaggatccggcgatgtgggagaatcttgaccggaatttcagacaagtgcaatcagttttagacagaaacagatcactgattcaacaagtcaacgacaatcaccaatcgagaatggctgataacatgtcgaagaacgttgctttgattcaagaactcaacggaaacatttccaaggttgttaacatgtattctgatctcaatactagtttctcgtcgggctttcacggtgggaagaacggtcacgatggtggtggtgctgccggaactagagcttaatgaaccggaatcaaattgtttcttcttagttggaccggccggtttgagaattttgaatctgtccggttcaagctatgatataaagtaaatgtttagtttttgtattgcaatgatgattgtcgttagaataatccgtgggagcaaacccatctctattggggttattttagttatggttttgagtctttttcaatgtgtctctactgcaatctctctaatgattataataataattgatacagtattagatt

SEQ ID NO: 972 - DNA, 1818 bp, Arabidopsis thaliana
gtgatcgaaagataccaaactaaagagtttaactttcttcttccttcttctttacttcaacatctgatattttctctctctcttttattcagtctgaaacaatatttctcggtagattaagatctaaagctcgttgatctagattcttgtttctatttttgtgtgttttaggctttgttggttttaccaagtgttgtgattcagtttgttttgaggtctgagtctatgggggagattgtggttttaagtagtgatgatggtatggagactataaagaacagagtaaagtcatcggaagttgttcagtgggagaagtatttgcctaaaactgtacttagggttttgttagttgaatctgattactcaactcgtcaaatcatcactgcccttcttcgtaaatgctgttacaaagttgtagctgtttctgatggtttagctgcgtgggaggttctaaaggagaagtcacataacattgatcttatactaacagagctggatttgccatctatatctggttttgctctgcttgctttggtaatggagcatgaagcttgcaagaacattcctgtcataatgatgtcttctcaagattcgataaaaatggtgttgaagtgtatgctgagaggtgctgctgattatctaatcaaaccaatgaggaaaaacgagttgaaaaatctatggcaacatgtttggagaagactgactttgcgtgatgatcctactgctcatgctcaaagcttaccagcttcacagcacaaccttgaagatactgatgaaacttgtgaagattccagatatcattcagatcaaggaagtggtgctcaggctatcaattacaatggtcacaataagctgatggagaatggcaaatcagtggatgaaagagacgagtttaaggaaacttttgatgtgacaatggatttgattggtggaattgacaagcgtcctgatagtatttataaagacaagagtcgagatgagtgtgttggtcctgagcttggactttctctgaaaagatcttgctctgtaagttttgagaaccaagatgaaagcaagcatcaaaagcttagcctctctgatgcgtcggccttctcaagatttgaggaaagcaagtcagcagaaaaagccgtcgttgctttagaggagagtacttcaggtgagccaaagacaccaaccgaatcacatgaaaagttaagaaaagtaacatctgatcaaggaagcgccacaacgagcagcaaccaggagaatatcggatcatcaagcgtaagcttccgtaaccaagttcttcagtccacagtaacgaatcagaagcaagattcacccataccggtagaatcaaatcgcgagaaagcagctagcaaggaagtagaagctggttctcaaagcaccaatgaggggattgctggacaaagcagtagcacagagaaaccaaaggaagaagaaagtgcgaaacaacgttggagtagaagccagagagaagctgcattgatgaagttccggttgaagaggaaagatcgatgctttgacaaaaaggttcggtaccagagcaggaagaagctagcagaacaacgtcctcgagtgaaaggccagttcgtgcgaaccgtgaattcagacgcgtctacaaaatcatgaagagctctttcagtttttcctctgatttcttttgttgattttataacagaaacttatttagcttttgcaatctttagtgtgctttttttttttatgtatttgattggcttcttcttctcagctaatatgagatactggggcaacttttgtatatatgtctgcaaatgatcaggctaagctaaaaca

SEQ ID NO: 973 - DNA, 1882 bp, Arabidopsis thaliana
attctgaggtagtggcaaaagtgggctgagtgctagaaatttttgaatgttccttgtgataagccatagaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttccaacctggaaagaacttcactca

SEQ ID NO: 974 - DNA, 608 bp, Arabidopsis thaliana
attaatcgtcaatttacaactagtcgcgaaatccgaattttatccaaagcaatggcaccgaaggcagagaagaaaccgtcggagaaagcaccaaaggcagataagaagatcacgaaagaaggaggaagcgagaggaagaagaagactaagaagagcacagagacgtacaagatctacctattcaaggtgttgaaacaagttcatcctgatatcgggatctctggaaaagccatgggaatcatgaacagtttcatcaacgacaccttcgagaaaattgctctggaatcgtcgcgattggctaggtataacaagaaaccgacgatcacgtcccgggaaatccaaaccgccgtaaggctcgtgttgcctggtgaattagcgaagcacgctgtttctgagggtaccaaagccgtcaccaaattcaccagttcttagattaggttctttttttctcttcgattttattttcggttaatatgttcaccagttgatttcaaagatataattttcggcagtctcttcgatattttctatgattgattttacgttatgatgctattgaaattagggtttacaaatctttgggtataataaatacaaaattgtaaagg

SEQ ID NO: 975 - DNA, 647 bp, Arabidopsis thaliana
gcttatcttaatttccctcgcattgagaattttcaactttttctatctctcttcccaaatcacaaatggcgggtcgcggcaaaactctcggatctggcgttgctaagaaatcaacatcgagaagcagcaaagccggtctccaattccccgttggtcgtatcgctcgttttctaaagaacggcaagtacgcaacacgtgttggtgccggagctccggtttacttagccgccgttctcgaatacctcgccgctgaggtattggaattggctggaaacgcagctagggataacaagaagactaggattgtgccacgtcacattcagctcgcggtgagaaacgatgaggagctgagtaaactgcttggagatgtgacgattgctaatggaggtgtgatgcctaacattcacagtcttcttcttcccaagaaagctggtgcttcaaaaccttccgctgatgaagattagattagggatttgtgttgtggttgtttagctaattaatgtgtagcttagtctttcattagattagatctgaattagttttcattaatggtgttgtgtagtctctcttttgcttcaaaaacaagtattaaaatcttattattttgaattgaatccacaatcaatacacattgaagtcctaacaaa

SEQ ID NO: 976 - DNA, 833 bp, Arabidopsis thaliana
ataccaatcaaacacgacagtctcaacaatcaaaagcttcaaatttttcattgtcaagaattctcaaaatggctagaacaaagcaaacagctagaaaatccaccggaggaaaagctcctagaaagcaactggcgacgaaagcagcaaggaaatcagctccagccaccggaggagtgaagaagccacacagattccgtccaggaacagtagcgttacgtgaaatcagaaagtatcaaaaaagcacagagcttttgatccgtaagcttcctttccagagattggttcgtgagatagctcaagatttcaagacggatcttaggtttcagagtagtgcagtcgcagctcttcaagaagcagctgaagcttatttggttggattgtttgaagatactaatctttgtgctattcatgctaagagggttacgattatgcctaaggatattcaacttgcgaggaggattagaggtgagagggcttaagatttgaagaagatgaagaagaaaaacaatggtctagtgtagatttgcttgtttgctctcataagatttgtagattcatgttttagatttggttttgagttttcttagtcttttgttctgaagtgtcttccagatgttcgatgaaatgcccaaatgaaaatttaatctacttttgcaactttctaagaatcagtcttcagtttaacttattagatttgcaattgaagttgtcattttggttgtaacttatttgtatattgttacatctgtattcaggtcttagtgacttgtgtcaaaatggttctaatttattgaccaaagcagggttaatcattttattttcctgcagcataa

SEQ ID NO: 977 - DNA, 727 bp, Arabidopsis thaliana
agatatcaaaatcactcagatctgtgcttcttcttcttcacccagaaaagtaaaacaaaagtcaaaacaatggcgccgagagcagagaagaagcccgcggagaagaaaccagccgccgagaaaccagtagaggagaaatcaaaagccgagaaagctccggcggagaagaaaccaaaagccggcaagaaactcccgaaggaagccggggccggcggcgataagaagaagaagatgaagaagaagagtgtggaaacttacaagatctacatcttcaaggttctgaaacaagttcatccagatattggtatttcaagcaaggctatgggtattatgaacagtttcatcaacgacatcttcgagaaattggcatcggaatcttcaaagctcgctaggtataacaagaagccgacgattacttctcgggagattcagactgctgttagactcgttcttcctggtgagctcgctaaacacgctgtttctgaaggaaccaaggctgttaccaaattcacaagctcttgaattagtaaattagggtttgtatactctgaatttgattctgatgttgtcataacttgtgttaggatttctctttcgttttattaagctttaattatcattctccgttgtaaagtaatcttatgaatctgtcttcgaatcaaaagttctggttgttaatggctcaatgttgttctcttgtttaatcaatgtagaatcatgagaatca

SEQ ID NO: 978 - DNA, 684 bp, Arabidopsis thaliana
aacaaacacaaaacttgatctcacgactccatcttctaaaattcagaatctttctttgaaacttttttcgtgtgaagaaaatggcaccaaaggcagagaagaagccggcagagaagaaaccagtagaggagaaatcaaaagccgagaaagctcctgcagagaagaaaccaaaagccggcaagaaactcccgaaggaagccggtgccggcggcgataagaagaagaagatgaagaagaagagtgttgagacgtacaagatctacatcttcaaggttctgaaacaagttcatccagatattggtatttcaagcaaagctatggggattatgaacagtttcatcaacgacatctttgagaaattggcatcggaatcgtcgaagctcgcgaggtataataagaagccgacgattacttctcgggagattcagactgctgttagacttgttcttcctggtgagcttgcgaaacatgctgtttctgaaggaactaaggcggtgactaagtttactagctcttgaattgtggatcttgttgaaatcgatgtttgtaaaattagggttttttagatttgatggttgttgttgactctttgatcgatttctgtttcgttttcttgttgcgatgttaatcaaatcggatccgatttctttcttaaatcaaatctatcaagtaaaatcttttgct

SEQ ID NO: 979 - DNA, 518 bp, Arabidopsis thaliana
ctcaaatcatctcaatctcaattaaatcttcaaatcgaaaagtttccgaagaaaaattcaggttcctttagaaaatgtcaggtcgtggaaagggaggcaaaggtttgggcaaaggtggagccaaacgtcataggaaggttctgagagacaacatccaaggaatcactaaaccggcgattcggagattggctcgtagaggtggtgttaaacgtattagtggtttgatctacgaggagacacgtggcgttctcaagatctttttggaaaatgttatccgtgacgccgttacttacactgagcacgctcggaggaagacggtgactgctatggatgttgtttatgctcttaagagacaaggaagaactctctatggattcggtggttgaggattttagtgttttagagtgttgtctaggatttgctttagtgatttcattttggaatttcagatcgatttgtattcgcgtttgcgttgtaatgttgttccggataaatattcacggttgcgttttgatata

SEQ ID NO: 980 - DNA, 1501 bp, Arabidopsis thaliana
gtttcacttctgaaaaaaaaaaaaaaaaaaattgtttgctcatcatcttcacaaaccaaacttctcttcttctccgatctcagatttgaatttttatcgattttgagcttcgaagagctcaatctctaactgaatttcgagaaattagagagtttgaaatgggagaggaagtacaaatgagcgattacgatgtttccggcgacggagatagggtttctgaatgggagatgggattaccaagcgacgaagatctagcatctctttcttactctctgattccaccgaatttggcgatggcgtttagtatcacaccggagagaagccgtacgattcaggatgtgaatcgtgcatcggagacgacgctctcgtcgctacgtggtggatcttcaggtccaaatacctcgtcgtcgaataataacgtggaggaggaagatcgagttggatctagcagtcctggatcggattcgaagaagcaaaagacatcaaacggtgatggagatgacggtggcggtgtggatccggattcggcgatggcggcggaagaaggagattcaggaactgaagatctatctgggaaaacacttaaacgaccgcgtttagtgtggacaccgcagctacacaagagattcgttgacgttgtagctcacttagggatcaaaaacgctgttccgaagacgattatgcagctgatgaacgttgaaggattaactcgtgagaacgttgcgtctcatcttcaaaagtataggctttacctcaaaaggatgcagggattgactaatgaaggtccctctgcttcggataagctcttctcttcaacacctgttcctccacagagcttccaagatatcggtggcggtggcggtagcagcggtaatgttggagtgccgattccgggggcgtatggaacgcaacagatgatgcagatgccagtttatgcacatcatatgggtatgcaaggatatcatcatcaaaatcataatcatgatccttatcatcagaatcatcgtcatcatcatggagctggtggaaatggtgcgtttgagtcaaatccttatatgatgcagcagaataagtttggatccatggcttcttatccttctgttggaggtggaagcgcaaatgagaattaaaaagagtctatagatggattcaatgggggaggaagagataggttcttggtgtctacaaaatttcttatcttttgcggagttttccaccgcaaagtcccaaattgcatctgttcaggagaggatcatacaaagtatcatgtagaagctaaaccaagagaagactgcagacaaatttcatatactcatttttctatcttgtaagaggtaagtccctttgttttatttgtctgcagacttcttaaagtggtaatcaagagagtgaattgtttatttctgtgagagatggcgtcagacacaaactttattttaaaaatttataaaccaatcaaatgtttcagaagaagccattttaatacaatcaagtattcctc

SEQ ID NO: 981 - DNA, 689 bp, Arabidopsis thaliana
aaccagatttcgtttctttcgtcctttttttccttttgcattctctcgtcgtcgtctcaagatctagaagaaggaaacaacaatttcaagagacatggcaggcaaaggtggaaaaggactcgtagctgcgaagacgatggctgctaacaaggacaaagacaaggacaagaagaaacccatctctcgctctgctcgtgctggtattcagtttccagttggacgaattcacaggcaactgaagacccgagtctcggcacatggcagagttggtgccactgcagccgtctacacagcttcaatcctggagtatctgacagcagaggttcttgagttggctgggaatgcgagcaaggatctcaaagtgaagaggataacgccaaggcatctgcagttggcgattagaggagatgaggagctggacacactcatcaagggaacgattgctggaggtggtgtgatccctcacatccacaagtctctcatcaacaaaaccaccaaggagtgatgtgtagctttttatggtgtttgtatttctgtagtcttggactcattttcctttatccttttcttagttctttgactagtgttgacctcttctggacatcctcaggtgtacattagttaatttgaactctttaggttccttgttcaatcatatgttctctttctatgctattgtgatttgctta

SEQ ID NO: 982 - DNA, 667 bp, Arabidopsis thaliana
agatcaaaatcagaatcagaatcaaatttctcgtcgtgtcggagtaaatcaagccatggattccggaaccaaagtgaagaaaggagccgctggaagaagaagtggtggaggtcctaagaagaaaccggtttcccgttcggttaaatccggtctacagtttcctgtcggtaggatcggtcggtatcttaagaaaggtcgttattcgaagcgtgtcggaaccggagctccggtctatctcgccgccgtcctcgagtatcttgctgctgaggttctcgagcttgctggtaacgctgcaagagataacaaaaagaaccgtattataccacgccatgttctattagcggtgaggaacgacgaggagctagggacactactcaaaggcgtaaccattgcacacggcggtgttttaccaaacataaacccaatactcctcccaaagaagtctgagaaagcagcttcaactacaaaaacacccaaatcaccatcaaaggcaaccaaatcccctaagaaatcttagtacttctttcttcattcctctgtataacctactgtttctatctctctgtacgtttctctgtaaagacagaacagaatatctctttgttgttgtgagaaagcttagtttctctgatcgtcgttgtgaaataaaaaatgcaacgtttcatat

SEQ ID NO: 983 - DNA, 1382 bp, Arabidopsis thaliana
gttagcttctcggtgaaaaactcgattggtggctttattttgatctcagtagtacgatactttctagctagatcttcttcattgaatgctttctatgaacatgagaagagtgtttggaggtgtatctacagatttgtttccgtcgcgaagtatgtaccggccgctgcagtctgggggaaacttggttatgttgtttaaaggatgcagacggtttgtgagaacaacgtgtcgcgtttcgatccctggtggttctttggggaatgaatcaaaagcacctccaaggtttctgagggatagaaagattgttccagatgctgatccccccaatatggaagatatccacaagttgtatcgactttttgagcaaagctcgagactcaccatcttgactggagctggggttagcacagaatgtggaattccggattacagaagtcccaatggagcatacagttctggtttcaaaccaattacccatcaggagtttactcgatcaagccgagctcgtaggcggtattgggcgaggagttacgctggatggaggaggttcactgcagcacaaccaggaccagctcatactgctttagcatcactagaaaaagctggacgaataaattttatgatcacacaaaatgttgacaggttgcatcatcgtgctgggagcgatccacttgaattacatggcacagtatatactgttatgtgcttagagtgcggcttctcttttccccgagacttgtttcaggatcagctaaaagcaatcaatcctaagtgggctgaagctatagaaagtattgatcatggagatccaggatcagagaagagctttggcatgaaacaaaggcctgatggtgatatcgagattgacgaaaagttttgggaagagggttttcatataccagtatgtgagaagtgcaaaggagtcctaaagcctgatgtaattttctttggagacaacatcccgaaggaaagagctactcaagcaatggaagttgcaaaacagagcgatgcattcctcgtgttgggttcatccttaatgacaatgtctgcttttcgcctttgcagagcggctcatgaggctggtgctatgaccgcaattgtaaatataggcgaaacaagagctgatgacattgttccattgaaaatcaatgctagggttggtgagatattgcacagagttcttgacgtgggatcgctcagtgtcccagctctctagcacaatgtccggatcatttaagtaaactttggcaagagctatgttatcatttagatcacctatatatattatttataactaatcaaaatgaatgcttgtattcctgcaacgtatctcaagttgtaaatccaacatcaaataaaagagtaatcaacatcaaataata

SEQ ID NO: 984 - DNA, 664 bp, Arabidopsis thaliana
atcgatcgcattctcaccgaatcaaatccaaaagagcaaatttacaatcttgcgaactcctaaaatggctcgtaccaagcaaacagctcgtaaatccaccggaggaaaggcaccaaggaagcaactcgcgaccaaagctgcgaggaaatcagctccagccaccggaggagtgaagaagccacacagattccgtccaggaacggtggcgttgagagaaatcaggaagtatcagaagagtactgagcttttgatccgtaagcttccgttccagagattggttcgtgagattgctcaagatttcaagacggatctgaggttccagagcagtgccgtcgcagctcttcaggaagcagctgaggcttatcttgttgggctctttgaagatactaatctctgtgcgattcatgctaagagggttacgattatgcctaaggatatccagcttgcgaggagaatcagaggagagagggcttaagtgaacgaagatgatgaagattaagaagactagtcgtttagttatggattagcttgtttggtttcaatggatatgtaaagctgtctcttttcgttttcgagtgttattagttttttacttagatgtgtcttccagatgttcgatgaaatgcctaaaggaaattttaatctactgttgtctaatcttttg

SEQ ID NO: 985 - DNA, 396 bp, Arabidopsis thaliana
atggctcgttcgaaccagacagctcgtaaggcaacaggaggtaaggctccacacttcgccatgagagtatggcaacactcaactccgccgcttaagaaaccatatagatacaagccaggaacagtggcactcagggagatcaggaagtaccagaagaccacagacttagttataagaaaactccctttccaaagactggtgaaagagatagctcagagtctcaaggcagatctaaggttccagaccggtgctgtttccgctcttcaagaagccgctgaagcttttatggttggaatgtttgaggacaccaatttgtgtgccatgcatgccaaaagatcaactatcatgcctaaggatatccagctcgctaaaaggcttcgaggcgatagggtttga

SEQ ID NO: 986 - DNA, 666 bp, Arabidopsis thaliana
tatcaaatcaaaaccatcacagcaaaaaaaactcactccctagaaaagtttgaaaatggcgaaggcagataagaaaccagcggagaagaaaccggcagagaaaactccggcagccgaaccagcagcagcggcagagaagaaaccaaaagccggaaagaaactcccgaaggaaccagccggcgccggagacaagaagaagaagagatcaaagaagaacgttgagacatacaagatctacatcttcaaggtgttgaagcaagttcatccagatatcggaatctccagcaaagccatgggaatcatgaacagtttcatcaatgatatctttgagaaacttgctggtgagtcttcgaagcttgcgaggtacaacaagaagccgacgattacttctagggagattcagactgcggtgagacttgtgttgcctggagagttggcgaaacatgctgtttctgaagggactaaggcggttacgaagtttacgagttcttagatttggaatgtggttttgtaatggaggagaagtagtagtagtagttggaatgtgaaatagggtttatgcttttgggtatctttgagggttatgtaatatgggaattagggttttaatttatggcacggctatgaaatctacttaattttccaatgttcgattgcaatttcatt

SEQ ID NO: 987 - DNA, 2257 bp, Arabidopsis thaliana; identical to SEQ ID NO: 494

SEQ ID NO: 988 - DNA, 790 bp, Arabidopsis thaliana
agcaaatcgtaaaccgccacaaaaccgaaaaaaacactaattgtgctttccctttagattcatttgtattttcttttggagcttttgaacaatggagtcatcacaagcaacgacgaagccaacgagaggagcaggaggaaggaaaggtggagataggaagaagagtgttagtaaatctgttaaagctggtcttcaatttcccgttggtcgtatcgctcgttacttgaagaaaggtcggtacgctctccgatacggttccggtgctccggtttacctcgccgccgttctcgaatacctagccgccgaggtacttgagctagctgggaacgcagcgagagataataagaagaacaggataaaccctaggcatctatgtttagcgataaggaacgatgaggaattggggagattgcttcatggagttactattgctagtggtggtgttcttccaaacattaatccagttcttcttcctaagaaatcaacagcttcttcttctcaagcggagaaagcttctgctaccaaatctcctaagaaggcttgataaagaatagtatcgatgttgctttttggttatattcggatcttagatgaagaagaagaagaagaagaaacaacttgttttttgttttagaggatttgtgtaggtatctgaaatcttcttctctttgttttggtttgtcttatgtaaaaaccatgggaagatgattatgtttgttaacgcaatttgtaatggaaaataattaagttctgggattagtaacttcatctgtctaattaatttctgggt

SEQ ID NO: 989 - DNA, 753 bp, Arabidopsis thaliana
ttaaatcacaaatcttcaacttccgatactttcaatctctctaaactctcaatttcagtaatcgataaccgtagcaatggaatccaccggaaaagtgaagaaagctttcggaggaagaaaaccacctggtgccccaaaaaccaaatcggtttcgaaatcgatgaaagccggtcttcaattcccagtgggaagaatcactcgtttcctgaagaaaggacgatacgctcagagacttggtggtggtgctccggtttacatggccgccgttcttgaatacctcgccgcagaagttctggagcttgctggtaacgctgcgagagataacaagaaatcaaggataattccgaggcatcttcttctcgcgataaggaacgatgaagaattggggaaacttctgagtggtgtcacaatcgctcacggtggtgttttgcctaacatcaactctgttctattgcctaagaagtctgccactaaaccagctgaagaaaaggctaccaaatcaccagtcaagtctccaaagaaagcttaatctgctagagttttcgttgctagtttgtgtttgagctctggtgaatgtagaaatttgaagcttttggatcttagtttctatgtatttggtgatttagaatgttgttcaaaatccttttcctaatcataagaatttatgatctatctattatacgcttcgtctaatcttttggtccactcgtcgtaatgtcattagtgaatatttaataaacaactttgtcatcg

SEQ ID NO: 990 - DNA, 2100 bp, Arabidopsis thaliana
tttttaaattttctttctttttattctattttagtagcaatttggttctgtaaagttgttggtaaaagaaaaatagatacgaatcaaaacatttttgaatgattaggtgattaaatgctaagcaaatcagattaagcaaaaatctgttcttttttggttgtaatttggtttttcaagtcagatatggtgagagattctggtggtggtggtgttcatcaatggattatgtgaaaaagggattagaataagtttggggaaagaagaaatgtgcaagtgttatgtcagtgtagaggggaagtttctgcagaatcttagctgttacttgatgctgcttctattctatcttgttcatggaggctggtcttgacactttcatgagatattagtattctaaaaatgtgttttaataacattgaaactggtgatgaagtggaaaccgagaggcaagtgtttggttcatctgaagaagatgaatttcgagttgaagatactgctagaaataccaacaatgtacagatttctcaacaacagcagcaaccgctagctcatgttgtgaagtgggagaggtatctcccagttagatcgcttaaggttcttctggtggagaatgatgactcaacacgccatattgttactgcccttttaaagaattgcagctatgaagttactgctgttccggatgtccttgaagcctggagaattctagaagatgagaaaagttgcattgatcttgtcttaacagaggttgacatgcctgtgcattcaggaaccggtctgctgtccaagattatgagccataagacacttaagaacatccccgtcataatgatgtcatcacatgattctatggttctggtctttaagtgtttgtcgaatggtgctgttgattttctcgtgaaacccattagaaagaacgaactaaagaatctttggcaacatgtctggagaagatgtcacagctctagcggaagcggaagtgagagtggaatacatgacaagaagtcggtgaaacctgaaagcacccaagggtcagaaaatgatgccagcatcagtgatgaacacaggaatgaaagtgggagtagtggtggtttgagtaaccaagatggtgggagtgataacgggagtggaactcagagttcttggacaaaaagagccagtgatactaagagcacctcgccttcaaatcaatttcccgatgcacccaacaagaaaggaacctatgaaaatggatgtgcacatgttaatagactgaaggaggctgaagatcagaaggaacaaataggcacgggatcacagacaggaatgtctatgagtaagaaagctgaagaaccaggagatcttgaaaagaatgcaaagtattctgttcaagctttggagagaaacaatgatgacacgctgaatcgctcttctggtaactcacaagtagaaagcaaagcaccttcatctaaccgagaagatttgcaatcactcgagcaaactctgaaaaaaacaagagaggatagagattacaaagtcggtgatcgaagtgtgttgaggcattcaaatctctctgcattctcaaaatacaataatggtgctacttctgctaagaaggctccagaagaaaatgtggaaagttgttctcctcatgacagtcctattgcaaaactgttgggttcgagttcaagcagtgacaatcctttaaagcagcagtctagtggaagtgaccgatgggcacaaagagaagctgctttgatgaagtttcgccttaaacgtaaagagcgatgttttgagaaaaaggttaggtaccatagcaggaagaaactagctgagcaacggcctcacgtcaaaggtcaattcattcgcaagagggatgatcataaatcaggaagtgaagacaattgaacaacaaaattggtatagaagagagatccacctccaatatctgaagaacagaagaaaatttcacaaagtggcatttttttttttccatttccaaaaacagatagtagtcttgtttaaataacgtcattactattctacaaacataataatgtcgctatagtacttcttctctgaaaacaataactcattaacatttcaataaataatgttactcat

SEQ ID NO: 991 - DNA, 2707 bp, Arabidopsis thaliana
attgattgacaaaacaaaacaatgagtcttctttctcttctcactcttcttgtcggaaattcaccttctctctctctcctcctcatctcaccgccggcgttacgccggatctccggtgacttttgttgagcttttttgttgattcatgattcgatatagagaaaaaagaatttcctatttcagctctttgttcttagatttatctttttgtttgttcttatggataaaggattaggttgggggattaaaagagtagtttttgtttggttgtgagattacttgactttgttaaggggataaattaggcgactttgtagggacactgtaccgaaaaaccctagttctgatttggccatggaagtatcatagcacttactattgtcggctttacttcttctacttttgtataatccttttttttcttaggttctgtgattagatattttttttgtgtgggtttagttgttaatctgatcatggatttgaacggtgagtgtaaaggaggagatgggtttattgatagaagcagagtcaggattttgctttgtgacaatgattccacgagtttgggagaggtttttactctcctttcagagtgttcttatcaagtgactgcagtgaaatcagcaaggcaggtgattgatgcacttaatgcagagggacctgatatcgatataatactggcggaaattgatctcccaatggctaagggtatgaagatgctgaggtacatcacacgagacaaagatcttcgcagaatccctgtgataatgatgtcgaggcaagacgaagtccctgtcgttgtaaagtgcttgaagctaggtgcagctgactaccttgtgaagcctcttcgcaccaacgagcttctgaacttgtggacacacatgtggagaagaagacgcatgctaggacttgctgagaagaatatgttgagctatgattttgatcttgtgggatctgatcaaagtgatccaaacacaaatagtaccaacctgttctctgacgacacagatgatagaagtcttaggtccaccaacccacagagaggaaatttaagtcaccaggaaaatgagtggtctgttgctactgctcctgttcatgctcgtgatggtggtcttggtgctgatggaacagccacttcttctcttgctgttactgctatagagcctccattggatcatcttgctgggtctcaccatgagccaatgaaaagaaatagtaatccagcgcaattttcttcagcaccgaagaaaagtagattgaagatcggagagtcctctgctttctttacatatgtcaaatctactgtccttagaactaacggtcaggatcctcctcttgtcgatggaaatggctcacttcatcttcatcggggtttggcggagaagtttcaagtggtggctagtgaagggatcaacaacaccaaacaagcacgcagagcaacaccaaaatctactgtccttagaactaacggtcaggatcctcctcttgtcaatggaaatggctcacatcatcttcatcggggtgcggcggaaaagtttcaagtggtggctagtgaagggatcaacaacaccaaacaagcacacagaagtagagggaccgagcaataccattctcaaggagagaccttgcagaatggcgccagctatccacattcccttgagcggtcacgcacgcttcccacatcaatggaatctcatggtaggaactaccaagagggcaatatgaatattccccaagttgctatgaacagaagtaaagattcgtctcaagttgatggatcgggtttctctgcaccaaatgcctatccttactatatgcatggggtcatgaaccaagttatgatgcaatcagcagccatgatgcctcaatatggtcatcaaattcctcattgccaaccaaatcatccgaatggaatgacgggatatccttactaccaccacccaatgaacacatctttgcagcatagtcagatgtctttacagaatggtcagatgtctatggttcatcattcttggtcaccggcaggaaatccgccttctaatgaggtgagggtaaataaacttgacagaagagaggaagctctgctgaaattcagacgtaaaaggaaccaacgttgttttgataagaagattaggtatgtgaataggaaacgccttgctgagaggagaccccgcgttaagggtcagtttgttaggaagatgaacggcgtgaatgttgatttaaatggacagcctgactctgctgactatgatgacgaggaagaggaggaagaagaagaagaagaggagaaccgggattcatctcctcaggatgatgctttgggaacttgaagatacaccaagaactgaaaaccgttgtgttatacgtatttgcttgcatcttatcaaacaacagaagatgttgatcgactgacacgaaaaagatgatactgctacagccaaaaaaacatcgaatatcgagttgtctctaaggcaatgttggctcttgcggctcaactttttgacagagcattgaaaagctctcattgggtttagcttagttcgttgataaacatataatgtattttatcatgttcactcacattctctcagtaagtactcagatgtattaacctttcttctccttccagtatcatttacttgaatcttgtttttccctcgctctctcacctgtgtttacatatataattatatataatcgctcc

SEQ ID NO: 992 - DNA, 723 bp, Arabidopsis thaliana
atcttcttcttcttcatcaaatctcacaaatcttcaacacttaatcacaaatctcaaagcttcggataccaaatggctcgtaccaagcaaaccgcaaggaaatccaccggaggaaaagccccaaggaaacaactcgcaacaaaggcggcgaggaaatcagctccggcgaccggaggagtaaagaagccacacagattccgtcctggaactgttgccctaagagaaatcaggaagtatcagaagagcactgagcttctgatccgcaagcttccgttccagcgtttggttcgtgagatcgctcaggatttcaaaacagatctgcgtttccagagcagcgccgtcgcagcacttcaggaagcggctgaagcatacctcgttggattgtttgaagacaccaatctttgcgcgattcatgctaagagagtcactatcatgcctaaggatattcaattggcgaggagaattagaggcgagagggcttaagaaggagattgaagtactctagactgtgatcgttatgcttatgtatatctttcgttttccctaatttcgtgttttagggttggattaggttttgcgtttatgttgttcgatatctaacggatcaaaatctctccttccttagcaaagtttgaaaactccctccacattttcatctccttttccacataaccaactcaacacttttcaatttctataacaatttcgagaaatcaaaaccag

SEQ ID NO: 993 - protein, 148 aa, Arabidopsis thaliana
MAPRAEKKPAEKKTAAERPVEENKAAEKAPAEKKPKAGKKLPPKEAGDKKKKRSKKNVETYKIYIFKVLKQVHPDIGISSKAMGIMNSFINDIFEKLAQESSKLARYNKKPTITSREIQTAVRLVLPGELAKHAVSEGTKAVTKFTSS

SEQ ID NO: 994 - protein, 136 aa, Arabidopsis thaliana
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 995 - protein, 1173 aa, Arabidopsis thaliana; identical to SEQ ID NO: 568

SEQ ID NO: 996 - protein, 132 aa, Arabidopsis thaliana
MVLLEKLWDDVVAGPQPDRGLGRLRKITTQPINIRDIGEGSSSKVVMHRSLTMPAAVSPGTPTTPTTPTTPRKDNVWRSVFNPGSNLATRAIGSNIFDKPTHPNSPSVYDCVDNEAQRKEHVALCLVGAWIK

SEQ ID NO: 997 - protein, 132 aa, Arabidopsis thaliana
MAGRGKTLGSGSAKKATTRSSKAGLQFPVGRIARFLKKGKYAERVGAGAPVYLAAVLEYLAAEVLELAGNAARDNKKTRIVPRHIQLAVRNDEELSKLLGDVTIANGGVMPNIHNLLLPKKTGASKPSAEDD

SEQ ID NO: 998 - protein, 136 aa, Arabidopsis thaliana
MARTKQTARKSHGGKAPRTLLATKAARKSAPTTGGVKKPHRYRPGTVALREIRKYQKSTELLIRKLPFQRLVREIAQDYKTDLRFQSHAVLALQEAAEAYLVGLFEDTNLCAIHAKRVTIMPKDVQLARRIRGERA

SEQ ID NO: 999 - protein, 159 aa, Arabidopsis thaliana
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGSYGGGGGRREGGGGYSGGGGGYSSRGGGGGSYGGGRREGGGGYGGGEGGGYGGSGGGGGW

SEQ ID NO: 1000 - protein, 151 aa, Arabidopsis thaliana
MAPKAGKKPAEKKPAEKAPAEEEKVAEKAPAEKKPKAGKKLPKEAVTGGVEKKKKRVKKSTETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 1001 - protein, 138 aa, Arabidopsis thaliana
MAPKAAEKKPAEKKPAGKAPAEKLPKAEKKISKDAGGSEKKKKKSKKSVETYKIYIFKVLKQVHPDVGISGKAMGIMNSFINDIFEKLAQESSKLARYNKKPTITSREIQTAVRLVLPGELAKHAVSEGTKAVTKFTS

SEQ ID NO: 1002 - protein, 111 aa, Arabidopsis thaliana
MKRNGETKRRRNVAEEAEQGEDPAMWENLDRNFRQVQSVLDRNRSLIQQVNDNHQSRMADNMSKNVALIQELNGNISKVVNMYSDLNTSFSSGFHGGKNGHDGGGAAGTRA

SEQ ID NO: 1003 - protein, 468 aa, Arabidopsis thaliana; identical to SEQ ID NO: 61

SEQ ID NO: 1004 - protein, 526 aa, Arabidopsis thaliana
MGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 1005 - protein, 126 aa, Arabidopsis thaliana
MAPKAEKKPSEKAPKADKKITKEGGSERKKKTKKSTETYKIYLFKVLKQVHPDIGISGKAMGIMNSFINDTFEKIALESSRLARYNKKPTITSREIQTAVRLVLPGELAKHAVSEGTKAVTKFTSS

SEQ ID NO: 1006 - protein, 132 aa, Arabidopsis thaliana
MAGRGKTLGSGVAKKSTSRSSKAGLQFPVGRIARFLKNGKYATRVGAGAPVYLAAVLEYLAAEVLELAGNAARDNKKTRIVPRHIQLAVRNDEELSKLLGDVTIANGGVMPNIHSLLLPKKAGASKPSADED

SEQ ID NO: 1007 - protein, 136 aa, Arabidopsis thaliana; identical to SEQ ID NO: 994

SEQ ID NO: 1008 - protein, 150 aa, Arabidopsis thaliana
MAPRAEKKPAEKKPAAEKPVEEKSKAEKAPAEKKPKAGKKLPKEAGAGGDKKKKMKKKSVETYKIYIFKVLKQVHPDIGISSKAMGIMNSFINDIFEKLASESSKLARYNKKPTITSREIQTAVRLVLPGELAKHAVSEGTKAVTKFTSS

SEQ ID NO: 1009 - protein, 145 aa, Arabidopsis thaliana
MAPKAEKKPAEKKPVEEKSKAEKAPAEKKPKAGKKLPKEAGAGGDKKKKMKKKSVETYKIYIFKVLKQVHPDIGISSKAMGIMNSFINDIFEKLASESSKLARYNKKPTITSREIQTAVRLVLPGELAKHAVSEGTKAVTKFTSS

SEQ ID NO: 1010 - protein, 103 aa, Arabidopsis thaliana
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 1011 - protein, 323 aa, Arabidopsis thaliana
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGAFESNPYMMQQNKFGSMASYPSVGGGSANEN

SEQ ID NO: 1012 - protein, 136 aa, Arabidopsis thaliana
MAGKGGKGLVAAKTMAANKDKDKDKKKPISRSARAGIQFPVGRIHRQLKTRVSAHGRVGATAAVYTASILEYLTAEVLELAGNASKDLKVKRITPRHLQLAIRGDEELDTLIKGTIAGGGVIPHIHKSLINKTTKE

SEQ ID NO: 1013 - protein, 153 aa, Arabidopsis thaliana
MDSGTKVKKGAAGRRSGGGPKKKPVSRSVKSGLQFPVGRIGRYLKKGRYSKRVGTGAPVYLAAVLEYLAAEVLELAGNAARDNKKNRIIPRHVLLAVRNDEELGTLLKGVTIAHGGVLPNINPILLPKKSEKAASTTKTPKSPSKATKSPKKS

SEQ ID NO: 1014 - protein, 376 aa, Arabidopsis thaliana
MLSMNMRRVFGGVSTDLFPSRSMYRPLQSGGNLVMLFKGCRRFVRTTCRVSIPGGSLGNESKAPPRFLRDRKIVPDADPPNMEDIHKLYRLFEQSSRLTILTGAGVSTECGIPDYRSPNGAYSSGFKPITHQEFTRSSRARRRYWARSYAGWRRFTAAQPGPAHTALASLEKAGRINFMITQNVDRLHHRAGSDPLELHGTVYTVMCLECGFSFPRDLFQDQLKAINPKWAEAIESIDHGDPGSEKSFGMKQRPDGDIEIDEKFWEEGFHIPVCEKCKGVLKPDVIFFGDNIPKERATQAMEVAKQSDAFLVLGSSLMTMSAFRLCRAAHEAGAMTAIVNIGETRADDIVPLKINARVGEILHRVLDVGSLSVPAL

SEQ ID NO: 1015 - protein, 136 aa, Arabidopsis thaliana; identical to SEQ ID NO: 994

SEQ ID NO: 1016 - protein, 131 aa, Arabidopsis thaliana
MARSNQTARKATGGKAPHFAMRVWQHSTPPLKKPYRYKPGTVALREIRKYQKTTDLVIRKLPFQRLVKEIAQSLKADLRFQTGAVSALQEAAEAFMVGMFEDTNLCAMHAKRSTIMPKDIQLAKRLRGDRV

SEQ ID NO: 1017 - protein, 145 aa, Arabidopsis thaliana
MAKADKKPAEKKPAEKTPAAEPAAAAEKKPKAGKKLPKEPAGAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 1018 - protein, 667 aa, Arabidopsis thaliana; identical to SEQ ID NO: 790

SEQ ID NO: 1019 - protein, 150 aa, Arabidopsis thaliana
MESSQATTKPTRGAGGRKGGDRKKSVSKSVKAGLQFPVGRIARYLKKGRYALRYGSGAPVYLAAVLEYLAAEVLELAGNAARDNKKNRINPRHLCLAIRNDEELGRLLHGVTIASGGVLPNINPVLLPKKSTASSSQAEKASATKSPKKA

SEQ ID NO: 1020 - protein, 150 aa, Arabidopsis thaliana
MESTGKVKKAFGGRKPPGAPKTKSVSKSMKAGLQFPVGRITRFLKKGRYAQRLGGGAPVYMAAVLEYLAAEVLELAGNAARDNKKSRIIPRHLLLAIRNDEELGKLLSGVTIAHGGVLPNINSVLLPKKSATKPAEEKATKSPVKSPKKA

SEQ ID NO: 1021 - protein, 495 aa, Arabidopsis thaliana
MCFNNIETGDEVETERQVFGSSEEDEFRVEDTARNTNNVQISQQQQQPLAHVVKWERYLPVRSLKVLLVENDDSTRHIVTALLKNCSYEVTAVPDVLEAWRILEDEKSCIDLVLTEVDMPVHSGTGLLSKIMSHKTLKNIPVIMMSSHDSMVLVFKCLSNGAVDFLVKPIRKNELKNLWQHVWRRCHSSSGSGSESGIHDKKSVKPESTQGSENDASISDEHRNESGSSGGLSNQDGGSDNGSGTQSSWTKRASDTKSTSPSNQFPDAPNKKGTYENGCAHVNRLKEAEDQKEQIGTGSQTGMSMSKKAEEPGDLEKNAKYSVQALERNNDDTLNRSSGNSQVESKAPSSNREDLQSLEQTLKKTREDRDYKVGDRSVLRHSNLSAFSKYNNGATSAKKAPEENVESCSPHDSPIAKLLGSSSSSDNPLKQQSSGSDRWAQREAALMKFRLKRKERCFEKKVRYHSRKKLAEQRPHVKGQFIRKRDDHKSGSEDN

SEQ ID NO: 1022 - protein, 618 aa, Arabidopsis thaliana
MDLNGECKGGDGFIDRSRVRILLCDNDSTSLGEVFTLLSECSYQVTAVKSARQVIDALNAEGPDIDIILAEIDLPMAKGMKMLRYITRDKDLRRIPVIMMSRQDEVPVVVKCLKLGAADYLVKPLRTNELLNLWTHMWRRRRMLGLAEKNMLSYDFDLVGSDQSDPNTNSTNLFSDDTDDRSLRSTNPQRGNLSHQENEWSVATAPVHARDGGLGADGTATSSLAVTAIEPPLDHLAGSHHEPMKRNSNPAQFSSAPKKSRLKIGESSAFFTYVKSTVLRTNGQDPPLVDGNGSLHLHRGLAEKFQVVASEGINNTKQARRATPKSTVLRTNGQDPPLVNGNGSHHLHRGAAEKFQVVASEGINNTKQAHRSRGTEQYHSQGETLQNGASYPHSLERSRTLPTSMESHGRNYQEGNMNIPQVAMNRSKDSSQVDGSGFSAPNAYPYYMHGVMNQVMMQSAAMMPQYGHQIPHCQPNHPNGMTGYPYYHHPMNTSLQHSQMSLQNGQMSMVHHSWSPAGNPPSNEVRVNKLDRREEALLKFRRKRNQRCFDKKIRYVNRKRLAERRPRVKGQFVRKMNGVNVDLNGQPDSADYDDEEEEEEEEEEENRDSSPQDDALGT

SEQ ID NO: 1023 - protein, 136 aa, Arabidopsis thaliana; identical to SEQ ID NO: 994

SEQ ID NO: 1024 - DNA, 1238 bp, Arabidopsis thaliana
tctccaccaccaaaatcctcctctctctctctctcttttactctgttttcatcatctctttctctcgtctctctcaaaccctaaatacactctttctcttcttgttgtctccattctctctgtgtcatcaagcttcttttttgtgtgggttatttgaaagacactttctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctcttgtttatttgttctctcagattgtaaatagttgaagttatctaattaatgtgataagagttatgtttatgattccaaaga

SEQ ID NO: 1025 - DNA, 4835 bp, Arabidopsis thaliana; identical to SEQ ID NO: 839

SEQ ID NO: 1026 - DNA, 2136 bp, Arabidopsis thaliana; identical to SEQ ID NO: 294

SEQ ID NO: 1027 - DNA, 1393 bp, Arabidopsis thaliana; identical to SEQ ID NO: 845

SEQ ID NO: 1028 - DNA, 3064 bp, Arabidopsis thaliana; identical to SEQ ID NO: 861

SEQ ID NO: 1029 - DNA, 2509 bp, Arabidopsis thaliana; identical to SEQ ID NO: 871

SEQ ID NO: 1030 - DNA, 1822 bp, Arabidopsis thaliana
ccttgacgaattctatatacctagttcgttttttcttcctcaaatatatctttttcaatttatttggtttttctttgggtgcaacttcacctcacaaaattttctctctttttttatattaatttgagttaggcctttttgatttcatagatgagtcgtctagtcgtctggatttgatgtggttatagtcttacagagacctttgattgaaataagaacaaaagcaagaatacatacatcctcttcatcttacacccatccttttttatttttctagggttttatttttttttaatttattttttttctttgatttttatattctctctctctctcaaatctttactcatctgggtatggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaagattggagctccacctgatgtggttgatagaattacggcggcacggcaagactttgaggctcgacaacagcggtcaacaccgtctgtctctgcctcctctagagacccggagttagatcaattcatggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctgatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataagacatccaaaagctttagccacataataacaacctctcgttgctttcttgttacaactcatgttttgaattcccctacatcagtttgctacttatagctttctttgttttcacgccttttgtaatgtcttatgtcgttcggggagtttgagacttcctagtcagaaatatcccttcattttattttctctttttttcggtgtattttgtttttttgttttctcactaatgtttttatttaataatgtgtgaaaggaaaatgctattctg

SEQ ID NO: 1031 - DNA, 1719 bp, Arabidopsis thaliana
ataaacaaactcgagtgattacaaagaacttataaaccacttatgtggcatactaaaatttaacaaaaaaaaatgttttgcgaaaaataagaagattttgttcatcttttttggtaagatgccagtttagctaaagatatttttcatatataaaaatgacaataaacacattacaaaagacaaaccccacacggctctctctagccaaattacttggccacgaccataaacacaaaacaccgcttagcttctaaaatctgaacatcgagaaaaaatgagttggtggtgggctggcgccatcggagctgccaagaaactcgacgaagatgaaccatcacaaagcttcgagagcgtcgctctcatcatcggcgttactggaatcgtcggaaacagcttggcggagattctccctctttccgacacacccggtggtccatggaaagtctacggcgtcgctcgtcgtcctcgtcctacctggaacgccgatcatccgatcgattacatccagtgcgatgtctccgacgccgaagacacaagatccaagctttcccctttaaccgatgtcacacatgtcttctacgtcacctggaccaatcgtgaatcggaaagtgaaaactgtgaagcaaatggctcaatgctccgtaacgttctccaagcgattatcccatacgcgccaaatctccgacatgtttgtctccagacagggacaaagcactaccttggccctttcaccaacgttgacggacctcgtcacgatccaccgttcactgaggatatgccgagattgcagatccagaatttctattatacccaagaggatattctgtttgaagagatcaagaagatagaaaccgtgacgtggtctatccacagaccaaacatgatctttgggttctctccttatagtttgatgaacattgttgggactctctgtgtctatgcagcgatatgtaagcatgaagggtctccgttgttgtttcctgggagcaagaaagcttgggaagggttcatgacggcttctgacgcggatttgattgcggagcagcagatttgggcggcggttgatccgtatgcgaagaacgaggcgtttaactgcaacaatgctgatatcttcaagtggaagcatctgtggaagattctagctgagcagtttgggattgaggagtatggatttgaggaagggaagaatttggggttggtggagatgatgaaagggaaagagagagtgtgggaggagatggttaaggagaatcaattgcaagagaagaagcttgaggaagttggtgtgtggtggtttgctgatgttatacttggagttgaaggaatgattgatagtatgaacaagagtaaggaatatggcttccttggtttcaggaactccaacaactcttttatctcttggattgacaagtacaaggcgttcaagatcgtaccttgattccaaaacatacttggatgtttgtttactctggtttcatgtttatgtttctcccaaaatctcagttctttgttgtctaaatgaaataaaagcggtaccatctttttctgttcttttttttaattccatctttagtcttgtaaactctactcttttgggaatagttttcaatttttaaatatcgttacaagttgtaatggaaagatattggacaatggtgcagtgtcataaggacaaagagctttacaggctaatggaaataccagattctgtgttttgca

SEQ ID NO: 1032 - DNA, 1975 bp, Arabidopsis thaliana
gcaatatacacaacaaagtattaaatcttagatattgtgggtctccctttcttctattcattttcttattcattaaaaaaaaaaaatggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaaagggttgtttttattttttcataaggaattcgcaagttcgatttttacttgagatggtttcacacgtgtggtgatggttgatgatgggctttgagattgagagagttacgattatgatgataatgcagttcataatatgaatttggattttggaataggactaattaagtaattctgatcattgaggtgggtatcaaggttcatacaattcgtgattttttgttttgtctttggtatttattaattttaaaaatccattttggaatgaaatttgtgattacttttgtttatccg

SEQ ID NO: 1033 - DNA, 1156 bp, Arabidopsis thaliana; identical to SEQ ID NO: 895

SEQ ID NO: 1034 - DNA, 1030 bp, Arabidopsis thaliana
tttgtcttttgctctttctccttcctctccactaaaacatttctctattttttcctttttatttgtttgtttggtttctttaaattctcagcttctatacaaacctttctcaattcttcttgacattagggtttcctctttctttgagagggctaaaaccctaatatatccctctcattgactaaagagttaagcctactctatctactttggaagcgaaattcaaagggtaaggtaaaagcccttgaaagaggaagaaagatacaagatcctcaaagaacctaaagatctaaaggcaggttgtaagaagaaaaacaaatggcgtcgtcatcaaactcatacaactcaccatgcgcggcgtgcaagtttcttcgccggaaatgcatgccgggatgcatattcgcgccatattttccaccggaggagccacacaaattcgccaacgtccacaaaatctttggagcaagcaacgtcacgaagctcctcaacgagctcctccctcaccaacgtgaagacgcagtcaactccttagcctatgaggccgaggcacgtgtccgtgaccccgtctatggctgcgtcggagccatctcttatctccagagacaagtccataggcttcagaaggagctcgacgcagctaatgctgacttggcacattatggtttgtccacatcagccgccggagcacctggcaacgtcgtggacttggtttttcagcctcagccgcttccgtcgcagcaactgcctcccttgaacccggtttataggctttcgggggcaagtccggtgatgaatcagatgccacgtggcaccggagggtcgtatgggacttttcttccttggaacaatggtcatgatcagcaaggaggtaacatgtgagagtttataaattatgagtattcatcctctcatctctctctttctatatttatgtgtgtgtggtacgaatacgatattatttgtttaatgcatggactgtgtgtgggatattatttcctagcgaattataaatgcatggactgttcttatt

SEQ ID NO: 1035 - protein, 239 aa, Arabidopsis thaliana
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 1036 - protein, 1451 aa, Arabidopsis thaliana; identical to SEQ ID NO: 902

SEQ ID NO: 1037 - protein, 568 aa, Arabidopsis thaliana; identical to SEQ ID NO: 590

SEQ ID NO: 1038 - protein, 324 aa, Arabidopsis thaliana; identical to SEQ ID NO: 908

SEQ ID NO: 1039 - protein, 852 aa, Arabidopsis thaliana; identical to SEQ ID NO: 924

SEQ ID NO: 1040 - protein, 653 aa, Arabidopsis thaliana; identical to SEQ ID NO: 934

SEQ ID NO: 1041 - protein, 398 aa, Arabidopsis thaliana; identical to SEQ ID NO: 187

SEQ ID NO: 1042 - protein, 387 aa, Arabidopsis thaliana
MSWWWAGAIGAAKKLDEDEPSQSFESVALIIGVTGIVGNSLAEILPLSDTPGGPWKVYGVARRPRPTWNADHPIDYIQCDVSDAEDTRSKLSPLTDVTHVFYVTWTNRESESENCEANGSMLRNVLQAIIPYAPNLRHVCLQTGTKHYLGPFTNVDGPRHDPPFTEDMPRLQIQNFYYTQEDILFEEIKKIETVTWSIHRPNMIFGFSPYSLMNIVGTLCVYAAICKHEGSPLLFPGSKKAWEGFMTASDADLIAEQQIWAAVDPYAKNEAFNCNNADIFKWKHLWKILAEQFGIEEYGFEEGKNLGLVEMMKGKERVWEEMVKENQLQEKKLEEVGVWWFADVILGVEGMIDSMNKSKEYGFLGFRNSNNSFISWIDKYKAFKIVP

SEQ ID NO: 1043 - protein, 531 aa, Arabidopsis thaliana
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 1044 - protein, 375 aa, Arabidopsis thaliana [sequence omitted]

SEQ ID NO: 1045 - protein, 186 aa, Arabidopsis thaliana
MASSSNSYNSPCAACKFLRRKCMPGCIFAPYFPPEEPHKFANVHKIFGASNVTKLLNELLPHQREDAVNSLAYEAEARVRDPVYGCVGAISYLQRQVHRLQKELDAANADLAHYGLSTSAAGAPGNVVDLVFQPQPLPSQQLPPLNPVYRLSGASPVMNQMPRGTGGSYGTFLPWNNGHDQQGGNM

The invention claimed is:

1. A method for increasing seed yield in a plant relative to a control plant, comprising increasing expression in a plant of a nucleic acid encoding a polypeptide comprising a RING domain of a C3HC4 type and having at least 95% sequence identity to the amino acid sequence SEQ ID NO: 2, and selecting for a plant having increased seed yield relative to a control plant, said nucleic acid is operably linked to a High Mobility Group Protein (HMGP) promoter, and wherein said increased seed yield comprises increased total weight of seeds, increased number of filled seeds, and/or increased total number of seeds relative to a control plant.

2. The method of claim 1, wherein said increased expression is effected by introducing and expressing in a plant an isolated nucleic acid encoding said polypeptide.

3. The method of claim 1, wherein the increased seed yield is obtained under non-stress conditions.

4. The method of claim 1, wherein the HMGP promoter is from rice.

5. The method of claim 1, wherein the nucleic acid is of plant origin.

6. A plant obtained by the method of claim 1, or a plant part, seed, or progeny of said plant, wherein the plant, or said plant part, seed, or progeny comprises a recombinant nucleic acid encoding said polypeptide wherein said recombinant nucleic acid is operably linked to a HMGP promoter, and wherein the plant has increased total weight of seeds, increased number of filled seeds, and/or increased total number of seeds relative to a control plant.

7. A construct comprising:
   (i) a nucleic acid encoding a polypeptide comprising a RING domain of a C3HC4 type and having at least 95% sequence identity to the amino acid sequence of SEQ ID NO: 2;
   (ii) a High Mobility Group Protein (HMGP) promoter operably linked to and driving expression of the nucleic acid sequence of (i); and optionally
   (iii) a transcription termination sequence.

8. The construct of claim 7, wherein the HMGP promoter is from rice.

9. A method for making a plant having increased seed yield relative to a control plant, comprising transforming a plant with a construct comprising:
   (i) a nucleic acid encoding a polypeptide comprising a RING domain of a C3HC4 type and having at least 95% sequence identity to the amino acid sequence of SEQ ID NO: 2;
   (ii) at least one High Mobility Group Protein (HMGP) promoter capable of driving expression of the nucleic acid of (i); and optionally (iii) a transcription factor termination sequence, and selecting for a plant having increased seed yield relative to a control plant, wherein said increased seed yield comprises increased total weight of seeds, increased number of filled seeds, and/or increased total number of seeds relative to a control plant.

10. A plant obtained by the method of claim 9, or a plant part, seed, or progeny of said plant, wherein said plant, plant part, seed, or progeny comprises a recombinant nucleic acid encoding said polypeptide and wherein said recombinant nucleic acid is operably linked to a HMGP promoter.

11. A method for the production of a transgenic plant having increased seed yield relative to a control plant, comprising:
(i) introducing and expressing in a plant a nucleic acid encoding a polypeptide comprising a RING domain of a C3HC4 type and having at least 95% sequence identity to the amino acid sequence of SEQ ID NO: 2;
(ii) cultivating the plant under conditions promoting plant growth and development; and
(iii) selecting for a plant having increased seed yield relative to a control plant, wherein said nucleic acid is operably linked to a High Mobility Group Protein (HMGP) promoter, and wherein said increased seed yield comprises increased total weight of seeds, increased number of filled seeds, and/or increased total number of seeds relative to a control plant.

12. A transgenic plant having increased seed yield relative to a control plant, wherein said increased seed yield is conferred by increased expression of a nucleic acid encoding a polypeptide comprising a RING domain of a C3HC4 type and having at least 95% sequence identity to the amino acid sequence of SEQ ID NO: 2, wherein said nucleic acid is operably linked to a High Mobility Group Protein (HMGP) promoter, and wherein said plant has increased total weight of seeds, increased number of filled seeds, and/or increased total number of seeds relative to a control plant.

13. The plant of claim 6, wherein said plant is a crop plant, a monocot, a cereal, rice, maize, wheat, barley, millet, rye, triticale, *sorghum*, emmer, spelt, *secale*, einkorn, teff, milo or oats.

14. Harvestable parts of the plant of claim 13, wherein the harvestable parts comprise a recombinant nucleic acid encoding said polypeptide, wherein said recombinant nucleic acid is operably linked to a HMGP promoter, and wherein the harvestable parts are shoot biomass and/or seeds.

15. A product derived from the plant of claim 13 or from harvestable parts of said plant, wherein said product comprises a recombinant nucleic acid encoding said polypeptide and wherein said recombinant nucleic acid is operably linked to a HMGP promoter.

16. The method of claim 1, wherein the polypeptide is encoded by the nucleotide sequence of SEQ ID NO: 1 or comprises the amino acid sequence of SEQ ID NO: 2.

17. The method of claim 1, wherein the plant is a crop plant, a monocot, a cereal, rice, maize, wheat, barley, millet, rye, triticale, *sorghum*, emmer, spelt, *secale*, einkorn, teff, milo or oats.

18. The method of claim 1, wherein the plant having increased seed yield has increased early vigor and/or increased leafy biomass.

19. The method of claim 9, wherein the HMGP promoter is from rice.

20. The method of claim 9, wherein said nucleic acid comprises the nucleotide sequence of SEQ ID NO: 1 or encodes a polypeptide comprising the amino acid sequence of SEQ ID NO: 2.

21. The method of claim 9, wherein the plant is a crop plant, a monocot, a cereal, rice, maize, wheat, barley, millet, rye, triticale, *sorghum*, emmer, spelt, *secale*, einkorn, teff, milo or oats.

22. The method of claim 9, wherein the plant having increased seed yield has increased early vigor and/or increased leafy biomass.

23. The method of claim 11, wherein said HMGP promoter is from rice.

24. The method of claim 11, wherein said nucleic acid comprises the nucleotide sequence of SEQ ID NO: 1 or encodes a polypeptide comprising the amino acid sequence of SEQ ID NO: 2.

25. The method of claim 11, wherein the plant is a crop plant, a monocot, a cereal, rice, maize, wheat, barley, millet, rye, triticale, *sorghum*, emmer, spelt, *secale*, einkorn, teff, milo or oats.

26. The method of claim 11, wherein the plant having increased seed yield has increased early vigor and/or increased leafy biomass.

27. The transgenic plant of claim 12, wherein said HMGP promoter is from rice.

28. The transgenic plant of claim 12, wherein said nucleic acid comprises the nucleotide sequence of SEQ ID NO: 1 or encodes a polypeptide comprising the amino acid sequence of SEQ ID NO: 2.

29. The transgenic plant of claim 12, wherein the plant is a crop plant, a monocot, a cereal, rice, maize, wheat, barley, millet, rye, triticale, *sorghum*, emmer, spelt, *secale*, einkorn, teff, milo or oats.

30. The method of claim 12, wherein the plant having increased seed yield has increased early vigor and/or increased leafy biomass.

31. The method of claim 1, wherein said nucleic acid comprises a nucleotide sequence encoding a polypeptide comprising a RING domain of a C3HC4 type and having at least 98% sequence identity to the amino acid sequence of SEQ ID NO: 2.

32. The method of claim 11, wherein said nucleic acid comprises a nucleotide sequence encoding a polypeptide comprising a RING domain of a C3HC4 type and having at least 98% sequence identity to the amino acid sequence of SEQ ID NO: 2.

* * * * *